United States Patent 8,178,503 (RIBONUCLEIC ACID INTERFERENCE MOLECULES AND BINDING SITES DERIVED BY ANALYZING INTERGENIC AND INTRONIC REGIONS OF GENOMES) - sequence listing, part 17

SEQ ID NO: 726125 - DNA, 13 bp, C. elegans
tcatcaaaaaacc

SEQ ID NO: 726126 - DNA, 13 bp, C. elegans
tcatcaaaaaaga

SEQ ID NO: 726127 - DNA, 13 bp, C. elegans
tcatcaaaaaatt

SEQ ID NO: 726128 - DNA, 13 bp, C. elegans
tcatcaaaaatga

SEQ ID NO: 726129 - DNA, 13 bp, C. elegans
tcatcaaacaaat

SEQ ID NO: 726130 - DNA, 13 bp, C. elegans
tcatcaaacattt

SEQ ID NO: 726131 - DNA, 13 bp, C. elegans
tcatcaaatattt

SEQ ID NO: 726132 - DNA, 13 bp, C. elegans
tcatcaaattcaa

SEQ ID NO: 726133 - DNA, 13 bp, C. elegans
tcatcaatataaa

SEQ ID NO: 726134 - DNA, 13 bp, C. elegans
tcatcaatatttt

SEQ ID NO: 726135 - DNA, 13 bp, C. elegans
tcatcaattattt

SEQ ID NO: 726136 - DNA, 13 bp, C. elegans
tcatcaattcaat

SEQ ID NO: 726137 - DNA, 13 bp, C. elegans
tcatcaattgaaa

SEQ ID NO: 726138 - DNA, 14 bp, C. elegans
tcatcaatttcaat

SEQ ID NO: 726139 - DNA, 13 bp, C. elegans
tcatcaatttcta

SEQ ID NO: 726140 - DNA, 13 bp, C. elegans
tcatcaatttctg

SEQ ID NO: 726141 - DNA, 13 bp, C. elegans
tcatcaattttaa

SEQ ID NO: 726142 - DNA, 13 bp, C. elegans
tcatcaattttct

SEQ ID NO: 726143 - DNA, 13 bp, C. elegans
tcatcaattttta

SEQ ID NO: 726144 - DNA, 13 bp, C. elegans
tcatcacaaaaca

SEQ ID NO: 726145 - DNA, 13 bp, C. elegans
tcatcacaaataa

SEQ ID NO: 726146 - DNA, 13 bp, C. elegans
tcatcaccaaaaa

SEQ ID NO: 726147 - DNA, 13 bp, C. elegans
tcatcacgttctt

SEQ ID NO: 726148 - DNA, 13 bp, C. elegans
tcatcactttctt

SEQ ID NO: 726149 - DNA, 13 bp, C. elegans
tcatcactttttc

SEQ ID NO: 726150 - DNA, 13 bp, C. elegans
tcatcagaaaaaa

SEQ ID NO: 726151 - DNA, 13 bp, C. elegans
tcatcataatcat

SEQ ID NO: 726152 - DNA, 13 bp, C. elegans
tcatcatcaaaat

SEQ ID NO: 726153 - DNA, 13 bp, C. elegans
tcatcatcaaatt

SEQ ID NO: 726154 - DNA, 13 bp, C. elegans
tcatcatcattat

SEQ ID NO: 726155 - DNA, 13 bp, C. elegans
tcatcatcattgt

SEQ ID NO: 726156 - DNA, 14 bp, C. elegans
tcatcatcattttc

SEQ ID NO: 726157 - DNA, 13 bp, C. elegans
tcatcatcgtcat

SEQ ID NO: 726158 - DNA, 13 bp, C. elegans
tcatcatcgtcgt

SEQ ID NO: 726159 - DNA, 13 bp, C. elegans
tcatcatcttcat

SEQ ID NO: 726160 - DNA, 13 bp, C. elegans
tcatcatcttctt

SEQ ID NO: 726161 - DNA, 13 bp, C. elegans
tcatcatcttttc

SEQ ID NO: 726162 - DNA, 13 bp, C. elegans
tcatcatgaactt

SEQ ID NO: 726163 - DNA, 13 bp, C. elegans
tcatcattatcat

SEQ ID NO: 726164 - DNA, 13 bp, C. elegans
tcatcatttacta

SEQ ID NO: 726165 - DNA, 13 bp, C. elegans
tcatcatttcatt

SEQ ID NO: 726166 - DNA, 13 bp, C. elegans
tcatcattttaat

SEQ ID NO: 726167 - DNA, 13 bp, C. elegans
tcatcattttcta

SEQ ID NO: 726168 - DNA, 13 bp, C. elegans
tcatcattttctg

SEQ ID NO: 726169 - DNA, 13 bp, C. elegans
tcatcatttttcc

SEQ ID NO: 726170 - DNA, 13 bp, C. elegans
tcatccaaaaaac

SEQ ID NO: 726171 - DNA, 13 bp, C. elegans
tcatccagatcca

SEQ ID NO: 726172 - DNA, 13 bp, C. elegans
tcatccattttta

SEQ ID NO: 726173 - DNA, 13 bp, C. elegans
tcatccatttttc

SEQ ID NO: 726174 - DNA, 13 bp, C. elegans
tcatccttttttg

SEQ ID NO: 726175 - DNA, 13 bp, C. elegans
tcatcgaaaaaaa

SEQ ID NO: 726176 - DNA, 13 bp, C. elegans
tcatcgaaaaatc

SEQ ID NO: 726177 - DNA, 13 bp, C. elegans
tcatcgaaaattc

SEQ ID NO: 726178 - DNA, 13 bp, C. elegans
tcatcgaaattgg

SEQ ID NO: 726179 - DNA, 13 bp, C. elegans
tcatcgaattttg

SEQ ID NO: 726180 - DNA, 13 bp, C. elegans
tcatcgagtttgt

SEQ ID NO: 726181 - DNA, 13 bp, C. elegans
tcatcgattaaat

SEQ ID NO: 726182 - DNA, 13 bp, C. elegans
tcatcgattttca

SEQ ID NO: 726183 - DNA, 13 bp, C. elegans
tcatcgattttta

SEQ ID NO: 726184 - DNA, 13 bp, C. elegans
tcatcgatttttc

SEQ ID NO: 726185 - DNA, 13 bp, C. elegans
tcatcgatttttt

SEQ ID NO: 726186 - DNA, 13 bp, C. elegans
tcatcgggtgcat

SEQ ID NO: 726187 - DNA, 13 bp, C. elegans
tcatcgtcaaaaa

SEQ ID NO: 726188 - DNA, 13 bp, C. elegans
tcatcgtcgtcgt

SEQ ID NO: 726189 - DNA, 13 bp, C. elegans
tcatcgtcttctt

SEQ ID NO: 726190 - DNA, 13 bp, C. elegans
tcatctacagtaa

SEQ ID NO: 726191 - DNA, 13 bp, C. elegans
tcatctccaaaat

SEQ ID NO: 726192 - DNA, 13 bp, C. elegans
tcatctccatttt

SEQ ID NO: 726193 - DNA, 13 bp, C. elegans
tcatctgatttcg

SEQ ID NO: 726194 - DNA, 13 bp, C. elegans
tcatctggaaaat

SEQ ID NO: 726195 - DNA, 13 bp, C. elegans
tcatcttaaaaat

SEQ ID NO: 726196 - DNA, 13 bp, C. elegans
tcatcttcaaaaa

SEQ ID NO: 726197 - DNA, 13 bp, C. elegans
tcatcttcagaaa

SEQ ID NO: 726198 - DNA, 13 bp, C. elegans
tcatcttcatcat

SEQ ID NO: 726199 - DNA, 13 bp, C. elegans
tcatcttcttcta

SEQ ID NO: 726200 - DNA, 13 bp, C. elegans
tcatcttgaaaaa

SEQ ID NO: 726201 - DNA, 13 bp, C. elegans
tcatctttttcaa

SEQ ID NO: 726202 - DNA, 13 bp, C. elegans
tcatgaaaaaata

SEQ ID NO: 726203 - DNA, 13 bp, C. elegans
tcatgaaaaatga

SEQ ID NO: 726204 - DNA, 13 bp, C. elegans
tcatgaaacagta

SEQ ID NO: 726205 - DNA, 13 bp, C. elegans
tcatgaaattcgg

SEQ ID NO: 726206 - DNA, 13 bp, C. elegans
tcatgaaatttga

SEQ ID NO: 726207 - DNA, 13 bp, C. elegans
tcatgaatattca

SEQ ID NO: 726208 - DNA, 13 bp, C. elegans
tcatgaattttaa

SEQ ID NO: 726209 - DNA, 13 bp, C. elegans
tcatgaatttttc

SEQ ID NO: 726210 - DNA, 13 bp, C. elegans
tcatgagaatgcc

SEQ ID NO: 726211 - DNA, 13 bp, C. elegans
tcatgagattttt

SEQ ID NO: 726212 - DNA, 13 bp, C. elegans
tcatgataaaaaa

SEQ ID NO: 726213 - DNA, 13 bp, C. elegans
tcatgatatctca

SEQ ID NO: 726214 - DNA, 13 bp, C. elegans
tcatgatgagaaa

SEQ ID NO: 726215 - DNA, 13 bp, C. elegans
tcatgatgatgat

SEQ ID NO: 726216 - DNA, 13 bp, C. elegans
tcatgattttgtt

SEQ ID NO: 726217 - DNA, 13 bp, C. elegans
tcatgatttttgt

SEQ ID NO: 726218 - DNA, 13 bp, C. elegans
tcatgatttttta

SEQ ID NO: 726219 - DNA, 13 bp, C. elegans
tcatgcaaaatca

SEQ ID NO: 726220 - DNA, 13 bp, C. elegans
tcatgcatttttg

SEQ ID NO: 726221 - DNA, 13 bp, C. elegans
tcatgcctacctg

SEQ ID NO: 726222 - DNA, 13 bp, C. elegans
tcatggaaacaaa

SEQ ID NO: 726223 - DNA, 13 bp, C. elegans
tcatggagcagca

SEQ ID NO: 726224 - DNA, 13 bp, C. elegans
tcatgggaagaag

SEQ ID NO: 726225 - DNA, 13 bp, C. elegans
tcatgggagccct

SEQ ID NO: 726226 - DNA, 13 bp, C. elegans
tcatggtgcatca

SEQ ID NO: 726227 - DNA, 13 bp, C. elegans
tcatggtgcatcg

SEQ ID NO: 726228 - DNA, 13 bp, C. elegans
tcatgtgaaaaag

SEQ ID NO: 726229 - DNA, 13 bp, C. elegans
tcatgtgaaattt

SEQ ID NO: 726230 - DNA, 13 bp, C. elegans
tcatgtgattttt

SEQ ID NO: 726231 - DNA, 13 bp, C. elegans
tcatgttcttttg

SEQ ID NO: 726232 - DNA, 13 bp, C. elegans
tcatgttgatttt

SEQ ID NO: 726233 - DNA, 13 bp, C. elegans
tcatgtttcaaat

SEQ ID NO: 726234 - DNA, 13 bp, C. elegans
tcatgtttcaata

SEQ ID NO: 726235 - DNA, 13 bp, C. elegans
tcatgttttaaat

SEQ ID NO: 726236 - DNA, 13 bp, C. elegans
tcatgttttattg

SEQ ID NO: 726237 - DNA, 13 bp, C. elegans
tcatgtttttaat

SEQ ID NO: 726238 - DNA, 13 bp, C. elegans
tcatgttttttca

SEQ ID NO: 726239 - DNA, 13 bp, C. elegans
tcattaaaaaaga

SEQ ID NO: 726240 - DNA, 13 bp, C. elegans
tcattaaaaatca

SEQ ID NO: 726241 - DNA, 13 bp, C. elegans
tcattaaaactat

SEQ ID NO: 726242 - DNA, 13 bp, C. elegans
tcattaaaacttt

SEQ ID NO: 726243 - DNA, 13 bp, C. elegans
tcattaaaagtta

SEQ ID NO: 726244 - DNA, 13 bp, C. elegans
tcattaaagaaaa

SEQ ID NO: 726245 - DNA, 13 bp, C. elegans
tcattaaattgtt

SEQ ID NO: 726246 - DNA, 13 bp, C. elegans
tcattaagaaatt

SEQ ID NO: 726247 - DNA, 13 bp, C. elegans
tcattaatcaaaa

SEQ ID NO: 726248 - DNA, 13 bp, C. elegans
tcattacaaaatt

SEQ ID NO: 726249 - DNA, 13 bp, C. elegans
tcattaggtttta

SEQ ID NO: 726250 - DNA, 13 bp, C. elegans
tcattagttttta

SEQ ID NO: 726251 - DNA, 13 bp, C. elegans
tcattatcaattt

SEQ ID NO: 726252 - DNA, 13 bp, C. elegans
tcattatcatcat

SEQ ID NO: 726253 - DNA, 13 bp, C. elegans
tcattatgaaatt

SEQ ID NO: 726254 - DNA, 13 bp, C. elegans
tcattattattca

SEQ ID NO: 726255 - DNA, 13 bp, C. elegans
tcattattatttg

SEQ ID NO: 726256 - DNA, 13 bp, C. elegans
tcattattcatta

SEQ ID NO: 726257 - DNA, 13 bp, C. elegans
tcattatttcaaa

SEQ ID NO: 726258 - DNA, 13 bp, C. elegans
tcattatttttag

SEQ ID NO: 726259 - DNA, 13 bp, C. elegans
tcattatttttga

SEQ ID NO: 726260 - DNA, 13 bp, C. elegans
tcattcaaaaact

SEQ ID NO: 726261 - DNA, 13 bp, C. elegans
tcattcaaaaatc

SEQ ID NO: 726262 - DNA, 13 bp, C. elegans
tcattcaaaaatg

SEQ ID NO: 726263 - DNA, 13 bp, C. elegans
tcattcaaaaatt

SEQ ID NO: 726264 - DNA, 13 bp, C. elegans
tcattcaaaatgt

SEQ ID NO: 726265 - DNA, 13 bp, C. elegans
tcattcaaatata

SEQ ID NO: 726266 - DNA, 13 bp, C. elegans
tcattcaaatcgg

SEQ ID NO: 726267 - DNA, 13 bp, C. elegans
tcattcaaattca

SEQ ID NO: 726268 - DNA, 13 bp, C. elegans
tcattcaactttt

SEQ ID NO: 726269 - DNA, 13 bp, C. elegans
tcattcaatcatt

SEQ ID NO: 726270 - DNA, 13 bp, C. elegans
tcattcaatttca

SEQ ID NO: 726271 - DNA, 13 bp, C. elegans
tcattcaatttct

SEQ ID NO: 726272 - DNA, 13 bp, C. elegans
tcattcagcaatg

SEQ ID NO: 726273 - DNA, 13 bp, C. elegans
tcattcattcaaa

SEQ ID NO: 726274 - DNA, 13 bp, C. elegans
tcattcattcaat

SEQ ID NO: 726275 - DNA, 13 bp, C. elegans
tcattcattcatt

SEQ ID NO: 726276 - DNA, 13 bp, C. elegans
tcattcattgaaa

SEQ ID NO: 726277 - DNA, 13 bp, C. elegans
tcattcatttatc

SEQ ID NO: 726278 - DNA, 13 bp, C. elegans
tcattcatttcat

SEQ ID NO: 726279 - DNA, 13 bp, C. elegans
tcattcattttca

SEQ ID NO: 726280 - DNA, 13 bp, C. elegans
tcattcattttgt

SEQ ID NO: 726281 - DNA, 13 bp, C. elegans
tcattcatttttg

SEQ ID NO: 726282 - DNA, 13 bp, C. elegans
tcattcgaaaaag

SEQ ID NO: 726283 - DNA, 13 bp, C. elegans
tcattctcattct

SEQ ID NO: 726284 - DNA, 13 bp, C. elegans
tcattcttcaaaa

SEQ ID NO: 726285 - DNA, 13 bp, C. elegans
tcattcttcattc

SEQ ID NO: 726286 - DNA, 13 bp, C. elegans
tcattcttttcaa

SEQ ID NO: 726287 - DNA, 13 bp, C. elegans
tcattgaaaaaag

SEQ ID NO: 726288 - DNA, 13 bp, C. elegans
tcattgaaattgg

SEQ ID NO: 726289 - DNA, 13 bp, C. elegans
tcattgaagaaaa

SEQ ID NO: 726290 - DNA, 13 bp, C. elegans
tcattgaataaaa

SEQ ID NO: 726291 - DNA, 13 bp, C. elegans
tcattgaatgttt

SEQ ID NO: 726292 - DNA, 13 bp, C. elegans
tcattgaattatt

SEQ ID NO: 726293 - DNA, 13 bp, C. elegans
tcattgaattttc

SEQ ID NO: 726294 - DNA, 13 bp, C. elegans
tcattgaattttt

SEQ ID NO: 726295 - DNA, 13 bp, C. elegans
tcattgacaaaaa

SEQ ID NO: 726296 - DNA, 13 bp, C. elegans
tcattgactacct

SEQ ID NO: 726297 - DNA, 13 bp, C. elegans
tcattgagaattc

SEQ ID NO: 726298 - DNA, 13 bp, C. elegans
tcattgataaatt

SEQ ID NO: 726299 - DNA, 13 bp, C. elegans
tcattgattaatt

SEQ ID NO: 726300 - DNA, 13 bp, C. elegans
tcattgattcatt

SEQ ID NO: 726301 - DNA, 13 bp, C. elegans
tcattggaaattt

SEQ ID NO: 726302 - DNA, 13 bp, C. elegans
tcattggaattct

SEQ ID NO: 726303 - DNA, 13 bp, C. elegans
tcattggagcgca

SEQ ID NO: 726304 - DNA, 13 bp, C. elegans
tcattggatgcct

SEQ ID NO: 726305 - DNA, 13 bp, C. elegans
tcattgtctactc

SEQ ID NO: 726306 - DNA, 13 bp, C. elegans
tcattgttcaaaa

SEQ ID NO: 726307 - DNA, 13 bp, C. elegans
tcattgttcattt

SEQ ID NO: 726308 - DNA, 13 bp, C. elegans
tcattgttttcaa

SEQ ID NO: 726309 - DNA, 13 bp, C. elegans
tcattgtttttca

SEQ ID NO: 726310 - DNA, 13 bp, C. elegans
tcatttaaaaact

SEQ ID NO: 726311 - DNA, 13 bp, C. elegans
tcatttaaaggat

SEQ ID NO: 726312 - DNA, 13 bp, C. elegans
tcatttactcatt

SEQ ID NO: 726313 - DNA, 13 bp, C. elegans
tcatttatcaaat

SEQ ID NO: 726314 - DNA, 13 bp, C. elegans
tcatttattagtt

SEQ ID NO: 726315 - DNA, 13 bp, C. elegans
tcatttattgatt

SEQ ID NO: 726316 - DNA, 13 bp, C. elegans
tcatttcaaaatt

SEQ ID NO: 726317 - DNA, 13 bp, C. elegans
tcatttcaaagat

SEQ ID NO: 726318 - DNA, 13 bp, C. elegans
tcatttcaaagct

SEQ ID NO: 726319 - DNA, 13 bp, C. elegans
tcatttcaaatgt

SEQ ID NO: 726320 - DNA, 13 bp, C. elegans
tcatttcaatcaa

SEQ ID NO: 726321 - DNA, 13 bp, C. elegans
tcatttcaattga

SEQ ID NO: 726322 - DNA, 13 bp, C. elegans
tcatttcacgcca

SEQ ID NO: 726323 - DNA, 13 bp, C. elegans
tcatttcagagaa

SEQ ID NO: 726324 - DNA, 13 bp, C. elegans
tcatttcataatt

SEQ ID NO: 726325 - DNA, 13 bp, C. elegans
tcatttcattttg

SEQ ID NO: 726326 - DNA, 13 bp, C. elegans
tcatttccaaatt

SEQ ID NO: 726327 - DNA, 13 bp, C. elegans
tcatttccaattc

SEQ ID NO: 726328 - DNA, 13 bp, C. elegans
tcatttccacgtg

SEQ ID NO: 726329 - DNA, 13 bp, C. elegans
tcatttccagtaa

SEQ ID NO: 726330 - DNA, 13 bp, C. elegans
tcatttccatttc

SEQ ID NO: 726331 - DNA, 13 bp, C. elegans
tcatttctatcca

SEQ ID NO: 726332 - DNA, 13 bp, C. elegans
tcatttctcaaaa

SEQ ID NO: 726333 - DNA, 13 bp, C. elegans
tcatttctcaatt

SEQ ID NO: 726334 - DNA, 13 bp, C. elegans
tcatttctctcga

SEQ ID NO: 726335 - DNA, 13 bp, C. elegans
tcatttctgacaa

SEQ ID NO: 726336 - DNA, 13 bp, C. elegans
tcatttcttatca

SEQ ID NO: 726337 - DNA, 13 bp, C. elegans
tcatttcttgaaa

SEQ ID NO: 726338 - DNA, 13 bp, C. elegans
tcatttgaaaatg

SEQ ID NO: 726339 - DNA, 13 bp, C. elegans
tcatttgaaagag

SEQ ID NO: 726340 - DNA, 13 bp, C. elegans
tcatttgaaagct

SEQ ID NO: 726341 - DNA, 13 bp, C. elegans
tcatttgaaattt

SEQ ID NO: 726342 - DNA, 13 bp, C. elegans
tcatttgaacatt

SEQ ID NO: 726343 - DNA, 13 bp, C. elegans
tcatttgaagaag

SEQ ID NO: 726344 - DNA, 13 bp, C. elegans
tcatttgaagaat

SEQ ID NO: 726345 - DNA, 13 bp, C. elegans
tcatttgaataat

SEQ ID NO: 726346 - DNA, 13 bp, C. elegans
tcatttgaatatc

SEQ ID NO: 726347 - DNA, 13 bp, C. elegans
tcatttgaatatt

SEQ ID NO: 726348 - DNA, 13 bp, C. elegans
tcatttgaatctc

SEQ ID NO: 726349 - DNA, 13 bp, C. elegans
tcatttgaatttg

SEQ ID NO: 726350 - DNA, 13 bp, C. elegans
tcatttgataaaa

SEQ ID NO: 726351 - DNA, 13 bp, C. elegans
tcatttgatattt

SEQ ID NO: 726352 - DNA, 13 bp, C. elegans
tcatttgcaaaaa

SEQ ID NO: 726353 - DNA, 13 bp, C. elegans
tcatttgcaattt

SEQ ID NO: 726354 - DNA, 13 bp, C. elegans
tcatttgcacttt

SEQ ID NO: 726355 - DNA, 13 bp, C. elegans
tcatttggttaag

SEQ ID NO: 726356 - DNA, 13 bp, C. elegans
tcatttgttcatt

SEQ ID NO: 726357 - DNA, 13 bp, C. elegans
tcatttgttttca

SEQ ID NO: 726358 - DNA, 13 bp, C. elegans
tcattttaaagct

SEQ ID NO: 726359 - DNA, 13 bp, C. elegans
tcattttaaagta

SEQ ID NO: 726360 - DNA, 13 bp, C. elegans
tcattttaagaaa

SEQ ID NO: 726361 - DNA, 13 bp, C. elegans
tcattttacaaaa

SEQ ID NO: 726362 - DNA, 13 bp, C. elegans
tcattttaccaaa

SEQ ID NO: 726363 - DNA, 13 bp, C. elegans
tcattttatagtt

SEQ ID NO: 726364 - DNA, 13 bp, C. elegans
tcattttatcatc

SEQ ID NO: 726365 - DNA, 13 bp, C. elegans
tcattttattgat

SEQ ID NO: 726366 - DNA, 13 bp, C. elegans
tcattttcaacga

SEQ ID NO: 726367 - DNA, 13 bp, C. elegans
tcattttcaactc

SEQ ID NO: 726368 - DNA, 13 bp, C. elegans
tcattttcaagat

SEQ ID NO: 726369 - DNA, 13 bp, C. elegans
tcattttcaagct

SEQ ID NO: 726370 - DNA, 13 bp, C. elegans
tcattttcaataa

SEQ ID NO: 726371 - DNA, 13 bp, C. elegans
tcattttcaatag

SEQ ID NO: 726372 - DNA, 13 bp, C. elegans
tcattttcaatgt

SEQ ID NO: 726373 - DNA, 13 bp, C. elegans
tcattttcaattg

SEQ ID NO: 726374 - DNA, 13 bp, C. elegans
tcattttcagatt

SEQ ID NO: 726375 - DNA, 13 bp, C. elegans
tcattttcatctc

SEQ ID NO: 726376 - DNA, 13 bp, C. elegans
tcattttcattca

SEQ ID NO: 726377 - DNA, 13 bp, C. elegans
tcattttcattgt

SEQ ID NO: 726378 - DNA, 13 bp, C. elegans
tcattttccaatt

SEQ ID NO: 726379 - DNA, 13 bp, C. elegans
tcattttccactt

SEQ ID NO: 726380 - DNA, 13 bp, C. elegans
tcattttccatgt

SEQ ID NO: 726381 - DNA, 13 bp, C. elegans
tcattttcctcat

SEQ ID NO: 726382 - DNA, 13 bp, C. elegans
tcattttcgaaaa

SEQ ID NO: 726383 - DNA, 13 bp, C. elegans
tcattttcgaaat

SEQ ID NO: 726384 - DNA, 13 bp, C. elegans
tcattttcgacaa

SEQ ID NO: 726385 - DNA, 13 bp, C. elegans
tcattttcggcaa

SEQ ID NO: 726386 - DNA, 13 bp, C. elegans
tcattttctcact

SEQ ID NO: 726387 - DNA, 13 bp, C. elegans
tcattttctcatc

SEQ ID NO: 726388 - DNA, 13 bp, C. elegans
tcattttctgaaa

SEQ ID NO: 726389 - DNA, 13 bp, C. elegans
tcattttctgcaa

SEQ ID NO: 726390 - DNA, 13 bp, C. elegans
tcattttctgcat

SEQ ID NO: 726391 - DNA, 13 bp, C. elegans
tcattttctgtct

SEQ ID NO: 726392 - DNA, 13 bp, C. elegans
tcattttcttgaa

SEQ ID NO: 726393 - DNA, 13 bp, C. elegans
tcattttgaaatt

SEQ ID NO: 726394 - DNA, 13 bp, C. elegans
tcattttgaatat

SEQ ID NO: 726395 - DNA, 13 bp, C. elegans
tcattttgaatca

SEQ ID NO: 726396 - DNA, 13 bp, C. elegans
tcattttgataat

SEQ ID NO: 726397 - DNA, 13 bp, C. elegans
tcattttgatctt

SEQ ID NO: 726398 - DNA, 13 bp, C. elegans
tcattttgctctt

SEQ ID NO: 726399 - DNA, 13 bp, C. elegans
tcattttggattg

SEQ ID NO: 726400 - DNA, 13 bp, C. elegans
tcattttgggtct

SEQ ID NO: 726401 - DNA, 13 bp, C. elegans
tcattttggtttg

SEQ ID NO: 726402 - DNA, 13 bp, C. elegans
tcattttgtggat

SEQ ID NO: 726403 - DNA, 13 bp, C. elegans
tcattttgttaat

SEQ ID NO: 726404 - DNA, 13 bp, C. elegans
tcattttgttagt

SEQ ID NO: 726405 - DNA, 13 bp, C. elegans
tcatttttaaaag

SEQ ID NO: 726406 - DNA, 13 bp, C. elegans
tcatttttaaagt

SEQ ID NO: 726407 - DNA, 13 bp, C. elegans
tcatttttaatca

SEQ ID NO: 726408 - DNA, 13 bp, C. elegans
tcatttttacaaa

SEQ ID NO: 726409 - DNA, 13 bp, C. elegans
tcatttttaccaa

SEQ ID NO: 726410 - DNA, 13 bp, C. elegans
tcatttttatgtg

SEQ ID NO: 726411 - DNA, 13 bp, C. elegans
tcatttttcaaaa

SEQ ID NO: 726412 - DNA, 13 bp, C. elegans
tcatttttcaaag

SEQ ID NO: 726413 - DNA, 13 bp, C. elegans
tcatttttcaagg

SEQ ID NO: 726414 - DNA, 13 bp, C. elegans
tcatttttcacat

SEQ ID NO: 726415 - DNA, 13 bp, C. elegans
tcatttttcaccg

SEQ ID NO: 726416 - DNA, 13 bp, C. elegans
tcatttttccaaa

SEQ ID NO: 726417 - DNA, 13 bp, C. elegans
tcatttttccaat

SEQ ID NO: 726418 - DNA, 13 bp, C. elegans
tcatttttccacc

SEQ ID NO: 726419 - DNA, 13 bp, C. elegans
tcatttttcctaa

SEQ ID NO: 726420 - DNA, 13 bp, C. elegans
tcatttttcgcga

SEQ ID NO: 726421 - DNA, 13 bp, C. elegans
tcatttttctaaa

SEQ ID NO: 726422 - DNA, 13 bp, C. elegans
tcatttttctgca

SEQ ID NO: 726423 - DNA, 13 bp, C. elegans
tcatttttgaaaa

SEQ ID NO: 726424 - DNA, 13 bp, C. elegans
tcatttttgcaat

SEQ ID NO: 726425 - DNA, 13 bp, C. elegans
tcatttttggtct

SEQ ID NO: 726426 - DNA, 13 bp, C. elegans
tcatttttggtga

SEQ ID NO: 726427 - DNA, 13 bp, C. elegans
tcatttttgtata

SEQ ID NO: 726428 - DNA, 13 bp, C. elegans
tcatttttgtatg

SEQ ID NO: 726429 - DNA, 13 bp, C. elegans
tcattttttacac

SEQ ID NO: 726430 - DNA, 13 bp, C. elegans
tcattttttcaga

SEQ ID NO: 726431 - DNA, 13 bp, C. elegans
tcattttttccag

SEQ ID NO: 726432 - DNA, 13 bp, C. elegans
tcattttttctga

SEQ ID NO: 726433 - DNA, 13 bp, C. elegans
tcattttttgagc

SEQ ID NO: 726434 - DNA, 13 bp, C. elegans
tcattttttgcca

SEQ ID NO: 726435 - DNA, 13 bp, C. elegans
tcatttttttgaa

SEQ ID NO: 726436 - DNA, 13 bp, C. elegans
tcatttttttgcc

SEQ ID NO: 726437 - DNA, 13 bp, C. elegans
tccaaaaaaacgt

SEQ ID NO: 726438 - DNA, 13 bp, C. elegans
tccaaaaaaactg

SEQ ID NO: 726439 - DNA, 13 bp, C. elegans
tccaaaaaaactt

SEQ ID NO: 726440 - DNA, 13 bp, C. elegans
tccaaaaaaattc

SEQ ID NO: 726441 - DNA, 13 bp, C. elegans
tccaaaaaactca

SEQ ID NO: 726442 - DNA, 13 bp, C. elegans
tccaaaaaagcaa

SEQ ID NO: 726443 - DNA, 13 bp, C. elegans
tccaaaaaatccc

SEQ ID NO: 726444 - DNA, 13 bp, C. elegans
tccaaaaaatcga

SEQ ID NO: 726445 - DNA, 13 bp, C. elegans
tccaaaaaatgaa

SEQ ID NO: 726446 - DNA, 13 bp, C. elegans
tccaaaaaatttt

SEQ ID NO: 726447 - DNA, 13 bp, C. elegans
tccaaaaacaact

SEQ ID NO: 726448 - DNA, 13 bp, C. elegans
tccaaaaacagaa

SEQ ID NO: 726449 - DNA, 13 bp, C. elegans
tccaaaaaccaat

SEQ ID NO: 726450 - DNA, 13 bp, C. elegans
tccaaaaactcaa

SEQ ID NO: 726451 - DNA, 13 bp, C. elegans
tccaaaaacttaa

SEQ ID NO: 726452 - DNA, 13 bp, C. elegans
tccaaaaacttca

SEQ ID NO: 726453 - DNA, 13 bp, C. elegans
tccaaaaagaaag

SEQ ID NO: 726454 - DNA, 13 bp, C. elegans
tccaaaaagagca

SEQ ID NO: 726455 - DNA, 13 bp, C. elegans
tccaaaaagcttt

SEQ ID NO: 726456 - DNA, 13 bp, C. elegans
tccaaaaagtaca

SEQ ID NO: 726457 - DNA, 13 bp, C. elegans
tccaaaaagtttt

SEQ ID NO: 726458 - DNA, 13 bp, C. elegans
tccaaaaatcacg

SEQ ID NO: 726459 - DNA, 13 bp, C. elegans
tccaaaaatgtaa

SEQ ID NO: 726460 - DNA, 13 bp, C. elegans
tccaaaaatgttg

SEQ ID NO: 726461 - DNA, 13 bp, C. elegans
tccaaaaatgttt

SEQ ID NO: 726462 - DNA, 13 bp, C. elegans
tccaaaaattatt

SEQ ID NO: 726463 - DNA, 13 bp, C. elegans
tccaaaaattcaa

SEQ ID NO: 726464 - DNA, 13 bp, C. elegans
tccaaaaattcca

SEQ ID NO: 726465 - DNA, 13 bp, C. elegans
tccaaaaattcga

SEQ ID NO: 726466 - DNA, 13 bp, C. elegans
tccaaaaattttc

SEQ ID NO: 726467 - DNA, 13 bp, C. elegans
tccaaaacacaat

SEQ ID NO: 726468 - DNA, 13 bp, C. elegans
tccaaaacattct

SEQ ID NO: 726469 - DNA, 13 bp, C. elegans
tccaaaacatttc

SEQ ID NO: 726470 - DNA, 13 bp, C. elegans
tccaaaacatttt

SEQ ID NO: 726471 - DNA, 13 bp, C. elegans
tccaaaaccattt

SEQ ID NO: 726472 - DNA, 13 bp, C. elegans
tccaaaacgacca

SEQ ID NO: 726473 - DNA, 13 bp, C. elegans
tccaaaactacag

SEQ ID NO: 726474 - DNA, 13 bp, C. elegans
tccaaaactcgaa

SEQ ID NO: 726475 - DNA, 13 bp, C. elegans
tccaaaacttaaa

SEQ ID NO: 726476 - DNA, 13 bp, C. elegans
tccaaaacttcaa

SEQ ID NO: 726477 - DNA, 13 bp, C. elegans
tccaaaacttcta

SEQ ID NO: 726478 - DNA, 13 bp, C. elegans
tccaaaacttgaa

SEQ ID NO: 726479 - DNA, 13 bp, C. elegans
tccaaaagaacat

SEQ ID NO: 726480 - DNA, 13 bp, C. elegans
tccaaaagaagaa

SEQ ID NO: 726481 - DNA, 13 bp, C. elegans
tccaaaagttgaa

SEQ ID NO: 726482 - DNA, 13 bp, C. elegans
tccaaaagtttga

SEQ ID NO: 726483 - DNA, 13 bp, C. elegans
tccaaaatatgtt

SEQ ID NO: 726484 - DNA, 13 bp, C. elegans
tccaaaatctaat

SEQ ID NO: 726485 - DNA, 13 bp, C. elegans
tccaaaatctgtt

SEQ ID NO: 726486 - DNA, 13 bp, C. elegans
tccaaaattatgt

SEQ ID NO: 726487 - DNA, 13 bp, C. elegans
tccaaaattcaaa

SEQ ID NO: 726488 - DNA, 13 bp, C. elegans
tccaaaattccaa

SEQ ID NO: 726489 - DNA, 13 bp, C. elegans
tccaaaattccat

SEQ ID NO: 726490 - DNA, 13 bp, C. elegans
tccaaaattgcaa

SEQ ID NO: 726491 - DNA, 13 bp, C. elegans
tccaaaatttcag

SEQ ID NO: 726492 - DNA, 13 bp, C. elegans
tccaaaatttccc

SEQ ID NO: 726493 - DNA, 13 bp, C. elegans
tccaaaatttccg

SEQ ID NO: 726494 - DNA, 13 bp, C. elegans
tccaaaattttta

SEQ ID NO: 726495 - DNA, 13 bp, C. elegans
tccaaacaacgaa

SEQ ID NO: 726496 - DNA, 13 bp, C. elegans
tccaaaccgttag

SEQ ID NO: 726497 - DNA, 13 bp, C. elegans
tccaaactgaaaa

SEQ ID NO: 726498 - DNA, 13 bp, C. elegans
tccaaacttttct

SEQ ID NO: 726499 - DNA, 13 bp, C. elegans
tccaaactttttg

SEQ ID NO: 726500 - DNA, 13 bp, C. elegans
tccaaagtcaaat

SEQ ID NO: 726501 - DNA, 13 bp, C. elegans
tccaaataaattg

SEQ ID NO: 726502 - DNA, 13 bp, C. elegans
tccaaataactac

SEQ ID NO: 726503 - DNA, 13 bp, C. elegans
tccaaataccaaa

SEQ ID NO: 726504 - DNA, 13 bp, C. elegans
tccaaatatcttc

SEQ ID NO: 726505 - DNA, 13 bp, C. elegans
tccaaatattgaa

SEQ ID NO: 726506 - DNA, 13 bp, C. elegans
tccaaatatttaa

SEQ ID NO: 726507 - DNA, 13 bp, C. elegans
tccaaatatttca

SEQ ID NO: 726508 - DNA, 13 bp, C. elegans
tccaaatatttct

SEQ ID NO: 726509 - DNA, 13 bp, C. elegans
tccaaatccaaaa

SEQ ID NO: 726510 - DNA, 13 bp, C. elegans
tccaaatccaatt

SEQ ID NO: 726511 - DNA, 13 bp, C. elegans
tccaaatctaaaa

SEQ ID NO: 726512 - DNA, 13 bp, C. elegans
tccaaatgcattt

SEQ ID NO: 726513 - DNA, 13 bp, C. elegans
tccaaatggcgca

SEQ ID NO: 726514 - DNA, 13 bp, C. elegans
tccaaatgttcaa

SEQ ID NO: 726515 - DNA, 13 bp, C. elegans
tccaaattaattt

SEQ ID NO: 726516 - DNA, 13 bp, C. elegans
tccaaattatttt

SEQ ID NO: 726517 - DNA, 13 bp, C. elegans
tccaaattcaatt

SEQ ID NO: 726518 - DNA, 13 bp, C. elegans
tccaaattctcaa

SEQ ID NO: 726519 - DNA, 13 bp, C. elegans
tccaaatttcatc

SEQ ID NO: 726520 - DNA, 13 bp, C. elegans
tccaaatttccac

SEQ ID NO: 726521 - DNA, 13 bp, C. elegans
tccaaattttcac

SEQ ID NO: 726522 - DNA, 13 bp, C. elegans
tccaaattttccc

SEQ ID NO: 726523 - DNA, 13 bp, C. elegans
tccaaattttctg

SEQ ID NO: 726524 - DNA, 13 bp, C. elegans
tccaaattttgaa

SEQ ID NO: 726525 - DNA, 13 bp, C. elegans
tccaaatttttat

SEQ ID NO: 726526 - DNA, 13 bp, C. elegans
tccaaatttttgc

SEQ ID NO: 726527 - DNA, 13 bp, C. elegans
tccaacaaaaaag

SEQ ID NO: 726528 - DNA, 13 bp, C. elegans
tccaacacttctt

SEQ ID NO: 726529 - DNA, 14 bp, C. elegans
tccaacagccgaaa

SEQ ID NO: 726530 - DNA, 13 bp, C. elegans
tccaacattttcc

SEQ ID NO: 726531 - DNA, 13 bp, C. elegans
tccaaccatattt

SEQ ID NO: 726532 - DNA, 13 bp, C. elegans
tccaactacaaaa

SEQ ID NO: 726533 - DNA, 13 bp, C. elegans
tccaactattttt

SEQ ID NO: 726534 - DNA, 13 bp, C. elegans
tccaacttcaaaa

SEQ ID NO: 726535 - DNA, 13 bp, C. elegans
tccaactttttga

SEQ ID NO: 726536 - DNA, 13 bp, C. elegans
tccaagaaaaatt

SEQ ID NO: 726537 - DNA, 13 bp, C. elegans
tccaagaaaatca

SEQ ID NO: 726538 - DNA, 13 bp, C. elegans
tccaagaaatttt

SEQ ID NO: 726539 - DNA, 13 bp, C. elegans
tccaagcagattg

SEQ ID NO: 726540 - DNA, 14 bp, C. elegans
tccaaggagacaaa

SEQ ID NO: 726541 - DNA, 13 bp, C. elegans
tccaagtcaaaaa

SEQ ID NO: 726542 - DNA, 13 bp, C. elegans
tccaataaaaaag

SEQ ID NO: 726543 - DNA, 13 bp, C. elegans
tccaataaaattt

SEQ ID NO: 726544 - DNA, 13 bp, C. elegans
tccaataaattaa

SEQ ID NO: 726545 - DNA, 13 bp, C. elegans
tccaataatttca

SEQ ID NO: 726546 - DNA, 13 bp, C. elegans
tccaatattttat

SEQ ID NO: 726547 - DNA, 13 bp, C. elegans
tccaatattttct

SEQ ID NO: 726548 - DNA, 13 bp, C. elegans
tccaatcaaattt

SEQ ID NO: 726549 - DNA, 13 bp, C. elegans
tccaatggatttt

SEQ ID NO: 726550 - DNA, 13 bp, C. elegans
tccaatgtttttc

SEQ ID NO: 726551 - DNA, 13 bp, C. elegans
tccaatgtttttt

SEQ ID NO: 726552 - DNA, 13 bp, C. elegans
tccaattaaatgc

SEQ ID NO: 726553 - DNA, 13 bp, C. elegans
tccaattaatatt

SEQ ID NO: 726554 - DNA, 13 bp, C. elegans
tccaattcaaaat

SEQ ID NO: 726555 - DNA, 13 bp, C. elegans
tccaattccaaaa

SEQ ID NO: 726556 - DNA, 13 bp, C. elegans
tccaattccaatt

SEQ ID NO: 726557 - DNA, 13 bp, C. elegans
tccaattgctcat

SEQ ID NO: 726558 - DNA, 13 bp, C. elegans
tccaattgtagta

SEQ ID NO: 726559 - DNA, 13 bp, C. elegans
tccaatttcaatt

SEQ ID NO: 726560 - DNA, 13 bp, C. elegans
tccaatttccatt

SEQ ID NO: 726561 - DNA, 13 bp, C. elegans
tccaatttccttt

SEQ ID NO: 726562 - DNA, 13 bp, C. elegans
tccaatttcgctc

SEQ ID NO: 726563 - DNA, 13 bp, C. elegans
tccaatttcttca

SEQ ID NO: 726564 - DNA, 13 bp, C. elegans
tccaatttgtttt

SEQ ID NO: 726565 - DNA, 13 bp, C. elegans
tccaattttatca

SEQ ID NO: 726566 - DNA, 13 bp, C. elegans
tccaattttattc

SEQ ID NO: 726567 - DNA, 13 bp, C. elegans
tccaattttctct

SEQ ID NO: 726568 - DNA, 13 bp, C. elegans
tccaattttgata

SEQ ID NO: 726569 - DNA, 13 bp, C. elegans
tccaattttgcca

SEQ ID NO: 726570 - DNA, 13 bp, C. elegans
tccaatttttaaa

SEQ ID NO: 726571 - DNA, 13 bp, C. elegans
tccaatttttaac

SEQ ID NO: 726572 - DNA, 13 bp, C. elegans
tccaatttttcgt

SEQ ID NO: 726573 - DNA, 13 bp, C. elegans
tccaatttttctc

SEQ ID NO: 726574 - DNA, 13 bp, C. elegans
tccaatttttgtc

SEQ ID NO: 726575 - DNA, 13 bp, C. elegans
tccaatttttgtg

SEQ ID NO: 726576 - DNA, 13 bp, C. elegans
tccaattttttcg

SEQ ID NO: 726577 - DNA, 13 bp, C. elegans
tccacaattttct

SEQ ID NO: 726578 - DNA, 13 bp, C. elegans
tccacacaaaaat

SEQ ID NO: 726579 - DNA, 13 bp, C. elegans
tccacagccaaaa

SEQ ID NO: 726580 - DNA, 13 bp, C. elegans
tccacagtctctc

SEQ ID NO: 726581 - DNA, 13 bp, C. elegans
tccacagttttca

SEQ ID NO: 726582 - DNA, 13 bp, C. elegans
tccaccaaaaaat

SEQ ID NO: 726583 - DNA, 13 bp, C. elegans
tccaccaattttt

SEQ ID NO: 726584 - DNA, 13 bp, C. elegans
tccacccattttt

SEQ ID NO: 726585 - DNA, 13 bp, C. elegans
tccaccgattttc

SEQ ID NO: 726586 - DNA, 13 bp, C. elegans
tccaccgattttt

SEQ ID NO: 726587 - DNA, 13 bp, C. elegans
tccacctttaagt

SEQ ID NO: 726588 - DNA, 14 bp, C. elegans
tccacgacggccga

SEQ ID NO: 726589 - DNA, 13 bp, C. elegans
tccacgtcaccag

SEQ ID NO: 726590 - DNA, 13 bp, C. elegans
tccacgtggaaaa

SEQ ID NO: 726591 - DNA, 13 bp, C. elegans
tccacgtggaatt

SEQ ID NO: 726592 - DNA, 13 bp, C. elegans
tccacgtggacaa

SEQ ID NO: 726593 - DNA, 13 bp, C. elegans
tccacgtgttttt

SEQ ID NO: 726594 - DNA, 13 bp, C. elegans
tccactaaagttt

SEQ ID NO: 726595 - DNA, 13 bp, C. elegans
tccactaatttta

SEQ ID NO: 726596 - DNA, 13 bp, C. elegans
tccactcaaaatc

SEQ ID NO: 726597 - DNA, 13 bp, C. elegans
tccactcggacaa

SEQ ID NO: 726598 - DNA, 13 bp, C. elegans
tccactgaaattt

SEQ ID NO: 726599 - DNA, 13 bp, C. elegans
tccacttcccaat

SEQ ID NO: 726600 - DNA, 13 bp, C. elegans
tccactttaaaat

SEQ ID NO: 726601 - DNA, 13 bp, C. elegans
tccactttcaaaa

SEQ ID NO: 726602 - DNA, 13 bp, C. elegans
tccactttgaaaa

SEQ ID NO: 726603 - DNA, 13 bp, C. elegans
tccacttttcaaa

SEQ ID NO: 726604 - DNA, 13 bp, C. elegans
tccacttttcgaa

SEQ ID NO: 726605 - DNA, 13 bp, C. elegans
tccactttttcga

SEQ ID NO: 726606 - DNA, 13 bp, C. elegans
tccagaaaaactg

SEQ ID NO: 726607 - DNA, 13 bp, C. elegans
tccagaaaaatcg

SEQ ID NO: 726608 - DNA, 13 bp, C. elegans
tccagaaaatcca

SEQ ID NO: 726609 - DNA, 13 bp, C. elegans
tccagaaaatttt

SEQ ID NO: 726610 - DNA, 13 bp, C. elegans
tccagaaagtttc

SEQ ID NO: 726611 - DNA, 13 bp, C. elegans
tccagaaattgat

SEQ ID NO: 726612 - DNA, 13 bp, C. elegans
tccagaagatttt

SEQ ID NO: 726613 - DNA, 13 bp, C. elegans
tccagaagccaaa

SEQ ID NO: 726614 - DNA, 13 bp, C. elegans
tccagaagcttct

SEQ ID NO: 726615 - DNA, 13 bp, C. elegans
tccagaaggttct

SEQ ID NO: 726616 - DNA, 13 bp, C. elegans
tccagaagttttc

SEQ ID NO: 726617 - DNA, 13 bp, C. elegans
tccagaatattct

SEQ ID NO: 726618 - DNA, 13 bp, C. elegans
tccagaatatttg

SEQ ID NO: 726619 - DNA, 13 bp, C. elegans
tccagaatgttct

SEQ ID NO: 726620 - DNA, 13 bp, C. elegans
tccagacttttcc

SEQ ID NO: 726621 - DNA, 13 bp, C. elegans
tccagactttttt

SEQ ID NO: 726622 - DNA, 13 bp, C. elegans
tccagattttaaa

SEQ ID NO: 726623 - DNA, 13 bp, C. elegans
tccagatttttag

SEQ ID NO: 726624 - DNA, 13 bp, C. elegans
tccagatttttgc

SEQ ID NO: 726625 - DNA, 13 bp, C. elegans
tccagcaaaaatc

SEQ ID NO: 726626 - DNA, 13 bp, C. elegans
tccagctttcaaa

SEQ ID NO: 726627 - DNA, 13 bp, C. elegans
tccagtagacaaa

SEQ ID NO: 726628 - DNA, 14 bp, C. elegans
tccagttatttcaa

SEQ ID NO: 726629 - DNA, 13 bp, C. elegans
tccagttcaaaat

SEQ ID NO: 726630 - DNA, 13 bp, C. elegans
tccagttgaaaaa

SEQ ID NO: 726631 - DNA, 13 bp, C. elegans
tccagtttatttt

SEQ ID NO: 726632 - DNA, 13 bp, C. elegans
tccagttttcaaa

SEQ ID NO: 726633 - DNA, 13 bp, C. elegans
tccagttttcaat

SEQ ID NO: 726634 - DNA, 13 bp, C. elegans
tccagttttccaa

SEQ ID NO: 726635 - DNA, 13 bp, C. elegans
tccagttttccat

SEQ ID NO: 726636 - DNA, 13 bp, C. elegans
tccataaattttc

SEQ ID NO: 726637 - DNA, 13 bp, C. elegans
tccataatttcag

SEQ ID NO: 726638 - DNA, 13 bp, C. elegans
tccataattttca

SEQ ID NO: 726639 - DNA, 14 bp, C. elegans
tccataatttttca

SEQ ID NO: 726640 - DNA, 14 bp, C. elegans
tccatattctccat

SEQ ID NO: 726641 - DNA, 13 bp, C. elegans
tccatattgtttt

SEQ ID NO: 726642 - DNA, 13 bp, C. elegans
tccatattttctg

SEQ ID NO: 726643 - DNA, 13 bp, C. elegans
tccatcaaaaact

SEQ ID NO: 726644 - DNA, 13 bp, C. elegans
tccatcaaaactc

SEQ ID NO: 726645 - DNA, 14 bp, C. elegans
tccatcatattgca

SEQ ID NO: 726646 - DNA, 13 bp, C. elegans
tccatcattttct

SEQ ID NO: 726647 - DNA, 13 bp, C. elegans
tccatcattttta

SEQ ID NO: 726648 - DNA, 13 bp, C. elegans
tccatccatccat

SEQ ID NO: 726649 - DNA, 13 bp, C. elegans
tccatcgaacgaa

SEQ ID NO: 726650 - DNA, 13 bp, C. elegans
tccatcgattttc

SEQ ID NO: 726651 - DNA, 13 bp, C. elegans
tccatcgtttttc

SEQ ID NO: 726652 - DNA, 13 bp, C. elegans
tccatctccaaaa

SEQ ID NO: 726653 - DNA, 13 bp, C. elegans
tccatctttaata

SEQ ID NO: 726654 - DNA, 13 bp, C. elegans
tccatcttttcaa

SEQ ID NO: 726655 - DNA, 13 bp, C. elegans
tccatgaaaaatt

SEQ ID NO: 726656 - DNA, 13 bp, C. elegans
tccatgacagaaa

SEQ ID NO: 726657 - DNA, 13 bp, C. elegans
tccatgattctca

SEQ ID NO: 726658 - DNA, 13 bp, C. elegans
tccatgcaggcgc

SEQ ID NO: 726659 - DNA, 13 bp, C. elegans
tccatgcgccttt

SEQ ID NO: 726660 - DNA, 13 bp, C. elegans
tccattaaaaact

SEQ ID NO: 726661 - DNA, 13 bp, C. elegans
tccattatttcca

SEQ ID NO: 726662 - DNA, 13 bp, C. elegans
tccattattttcc

SEQ ID NO: 726663 - DNA, 13 bp, C. elegans
tccattcaaaact

SEQ ID NO: 726664 - DNA, 13 bp, C. elegans
tccattgattttt

SEQ ID NO: 726665 - DNA, 13 bp, C. elegans
tccatttcaaatt

SEQ ID NO: 726666 - DNA, 13 bp, C. elegans
tccatttcaattt

SEQ ID NO: 726667 - DNA, 13 bp, C. elegans
tccatttcatttc

SEQ ID NO: 726668 - DNA, 13 bp, C. elegans
tccatttccaatt

SEQ ID NO: 726669 - DNA, 13 bp, C. elegans
tccatttgatttt

SEQ ID NO: 726670 - DNA, 13 bp, C. elegans
tccatttgcaaaa

SEQ ID NO: 726671 - DNA, 13 bp, C. elegans
tccattttataaa

SEQ ID NO: 726672 - DNA, 13 bp, C. elegans
tccattttcaaaa

SEQ ID NO: 726673 - DNA, 13 bp, C. elegans
tccattttcagca

SEQ ID NO: 726674 - DNA, 13 bp, C. elegans
tccattttcataa

SEQ ID NO: 726675 - DNA, 13 bp, C. elegans
tccattttcatag

SEQ ID NO: 726676 - DNA, 13 bp, C. elegans
tccattttcccat

SEQ ID NO: 726677 - DNA, 13 bp, C. elegans
tccattttctata

SEQ ID NO: 726678 - DNA, 13 bp, C. elegans
tccatttttcaat

SEQ ID NO: 726679 - DNA, 13 bp, C. elegans
tccatttttccac

SEQ ID NO: 726680 - DNA, 13 bp, C. elegans
tccatttttccgg

SEQ ID NO: 726681 - DNA, 13 bp, C. elegans
tccatttttcgaa

SEQ ID NO: 726682 - DNA, 13 bp, C. elegans
tccatttttcgat

SEQ ID NO: 726683 - DNA, 13 bp, C. elegans
tccatttttcgtt

SEQ ID NO: 726684 - DNA, 13 bp, C. elegans
tccatttttgaaa

SEQ ID NO: 726685 - DNA, 13 bp, C. elegans
tccatttttgctt

SEQ ID NO: 726686 - DNA, 13 bp, C. elegans
tccattttttcca

SEQ ID NO: 726687 - DNA, 13 bp, C. elegans
tccattttttgta

SEQ ID NO: 726688 - DNA, 13 bp, C. elegans
tccattttttgtg

SEQ ID NO: 726689 - DNA, 13 bp, C. elegans
tcccaaaaaaaag

SEQ ID NO: 726690 - DNA, 13 bp, C. elegans
tcccaaaaattct

SEQ ID NO: 726691 - DNA, 13 bp, C. elegans
tcccaaaaattga

SEQ ID NO: 726692 - DNA, 13 bp, C. elegans
tcccaaaattgaa

SEQ ID NO: 726693 - DNA, 13 bp, C. elegans
tcccaaaatttta

SEQ ID NO: 726694 - DNA, 13 bp, C. elegans
tcccaaagtttca

SEQ ID NO: 726695 - DNA, 13 bp, C. elegans
tcccaaatttcca

SEQ ID NO: 726696 - DNA, 13 bp, C. elegans
tcccaatccatcc

SEQ ID NO: 726697 - DNA, 13 bp, C. elegans
tcccaatttcaat

SEQ ID NO: 726698 - DNA, 13 bp, C. elegans
tcccaattttcaa

SEQ ID NO: 726699 - DNA, 13 bp, C. elegans
tcccaatttttac

SEQ ID NO: 726700 - DNA, 13 bp, C. elegans
tcccacactctct

SEQ ID NO: 726701 - DNA, 13 bp, C. elegans
tcccaccaaaaat

SEQ ID NO: 726702 - DNA, 13 bp, C. elegans
tcccactactaac

SEQ ID NO: 726703 - DNA, 13 bp, C. elegans
tcccactattttc

SEQ ID NO: 726704 - DNA, 13 bp, C. elegans
tcccactgacact

SEQ ID NO: 726705 - DNA, 13 bp, C. elegans
tcccactgggcta

SEQ ID NO: 726706 - DNA, 13 bp, C. elegans
tcccaggaaccaa

SEQ ID NO: 726707 - DNA, 13 bp, C. elegans
tcccagttttctt

SEQ ID NO: 726708 - DNA, 14 bp, C. elegans
tcccatacttttga

SEQ ID NO: 726709 - DNA, 13 bp, C. elegans
tcccatcactttt

SEQ ID NO: 726710 - DNA, 13 bp, C. elegans
tcccatttgaatt

SEQ ID NO: 726711 - DNA, 13 bp, C. elegans
tcccattttccaa

SEQ ID NO: 726712 - DNA, 13 bp, C. elegans
tcccattttgaaa

SEQ ID NO: 726713 - DNA, 13 bp, C. elegans
tcccatttttcag

SEQ ID NO: 726714 - DNA, 13 bp, C. elegans
tcccattttttaa

SEQ ID NO: 726715 - DNA, 13 bp, C. elegans
tcccattttttgt

SEQ ID NO: 726716 - DNA, 13 bp, C. elegans
tccccaaaaaatc

SEQ ID NO: 726717 - DNA, 13 bp, C. elegans
tccccaattttca

SEQ ID NO: 726718 - DNA, 13 bp, C. elegans
tccccaattttta

SEQ ID NO: 726719 - DNA, 13 bp, C. elegans
tccccattgacga

SEQ ID NO: 726720 - DNA, 13 bp, C. elegans
tccccattggcgc

SEQ ID NO: 726721 - DNA, 13 bp, C. elegans
tcccccaaaaatc

SEQ ID NO: 726722 - DNA, 13 bp, C. elegans
tcccccagcaact

SEQ ID NO: 726723 - DNA, 13 bp, C. elegans
tcccccatcaact

SEQ ID NO: 726724 - DNA, 13 bp, C. elegans
tccccgccatttt

SEQ ID NO: 726725 - DNA, 13 bp, C. elegans
tccccggctagga

SEQ ID NO: 726726 - DNA, 13 bp, C. elegans
tcccgaaaataaa

SEQ ID NO: 726727 - DNA, 13 bp, C. elegans
tcccgaccatatc

SEQ ID NO: 726728 - DNA, 13 bp, C. elegans
tcccgatttttca

SEQ ID NO: 726729 - DNA, 13 bp, C. elegans
tcccgatttttct

SEQ ID NO: 726730 - DNA, 13 bp, C. elegans
tcccgcacttttt

SEQ ID NO: 726731 - DNA, 13 bp, C. elegans
tcccgcatttctt

SEQ ID NO: 726732 - DNA, 13 bp, C. elegans
tcccgcgaattct

SEQ ID NO: 726733 - DNA, 13 bp, C. elegans
tcccgcgattctc

SEQ ID NO: 726734 - DNA, 13 bp, C. elegans
tcccggatgtctg

SEQ ID NO: 726735 - DNA, 13 bp, C. elegans
tcccgtttgtccc

SEQ ID NO: 726736 - DNA, 13 bp, C. elegans
tcccgtttttaaa

SEQ ID NO: 726737 - DNA, 13 bp, C. elegans
tcccgtttttgtc

SEQ ID NO: 726738 - DNA, 20 bp, C. elegans
tccctattagacttgcactc

SEQ ID NO: 726739 - DNA, 13 bp, C. elegans
tccctcatatttt

SEQ ID NO: 726740 - DNA, 13 bp, C. elegans
tccctccaaaaaa

SEQ ID NO: 726741 - DNA, 13 bp, C. elegans
tccctctaaacat

SEQ ID NO: 726742 - DNA, 13 bp, C. elegans
tccctcttattca

SEQ ID NO: 726743 - DNA, 13 bp, C. elegans
tccctgaaaaaaa

SEQ ID NO: 726744 - DNA, 13 bp, C. elegans
tccctgatatgtc

SEQ ID NO: 726745 - DNA, 13 bp, C. elegans
tccctgattttat

SEQ ID NO: 726746 - DNA, 13 bp, C. elegans
tcccttcaaaaat

SEQ ID NO: 726747 - DNA, 13 bp, C. elegans
tccgaaaaaaaat

SEQ ID NO: 726748 - DNA, 13 bp, C. elegans
tccgaaaaaaacc

SEQ ID NO: 726749 - DNA, 13 bp, C. elegans
tccgaaaaaacca

SEQ ID NO: 726750 - DNA, 13 bp, C. elegans
tccgaaaaaagag

SEQ ID NO: 726751 - DNA, 13 bp, C. elegans
tccgaaaaaattt

SEQ ID NO: 726752 - DNA, 13 bp, C. elegans
tccgaaaaagtca

SEQ ID NO: 726753 - DNA, 13 bp, C. elegans
tccgaaaaatcta

SEQ ID NO: 726754 - DNA, 13 bp, C. elegans
tccgaaaacattt

SEQ ID NO: 726755 - DNA, 13 bp, C. elegans
tccgaaaatccat

SEQ ID NO: 726756 - DNA, 13 bp, C. elegans
tccgaaaatctaa

SEQ ID NO: 726757 - DNA, 13 bp, C. elegans
tccgaaaattaaa

SEQ ID NO: 726758 - DNA, 13 bp, C. elegans
tccgaaaattagt

SEQ ID NO: 726759 - DNA, 13 bp, C. elegans
tccgaaataaaaa

SEQ ID NO: 726760 - DNA, 13 bp, C. elegans
tccgaaattaaat

SEQ ID NO: 726761 - DNA, 13 bp, C. elegans
tccgaaattcaaa

SEQ ID NO: 726762 - DNA, 13 bp, C. elegans
tccgaattttccg

SEQ ID NO: 726763 - DNA, 13 bp, C. elegans
tccgaatttttct

SEQ ID NO: 726764 - DNA, 13 bp, C. elegans
tccgaattttttc

SEQ ID NO: 726765 - DNA, 13 bp, C. elegans
tccgacaaatcgg

SEQ ID NO: 726766 - DNA, 13 bp, C. elegans
tccgacagcttct

SEQ ID NO: 726767 - DNA, 13 bp, C. elegans
tccgagaggacta

SEQ ID NO: 726768 - DNA, 14 bp, C. elegans
tccgagaggagtac

SEQ ID NO: 726769 - DNA, 13 bp, C. elegans
tccgatctttgat

SEQ ID NO: 726770 - DNA, 14 bp, C. elegans
tccgatgtattcga

SEQ ID NO: 726771 - DNA, 13 bp, C. elegans
tccgattttcgat

SEQ ID NO: 726772 - DNA, 13 bp, C. elegans
tccgattttgaca

SEQ ID NO: 726773 - DNA, 13 bp, C. elegans
tccgattttttca

SEQ ID NO: 726774 - DNA, 13 bp, C. elegans
tccgattttttcg

SEQ ID NO: 726775 - DNA, 13 bp, C. elegans
tccgcaaatttgc

SEQ ID NO: 726776 - DNA, 13 bp, C. elegans
tccgcataaatgc

SEQ ID NO: 726777 - DNA, 13 bp, C. elegans
tccgcattttttg

SEQ ID NO: 726778 - DNA, 13 bp, C. elegans
tccgcattttttt

SEQ ID NO: 726779 - DNA, 13 bp, C. elegans
tccgccaattgaa

SEQ ID NO: 726780 - DNA, 13 bp, C. elegans
tccgccaatttgc

SEQ ID NO: 726781 - DNA, 13 bp, C. elegans
tccgccaattttg

SEQ ID NO: 726782 - DNA, 13 bp, C. elegans
tccgcccaaaaaa

SEQ ID NO: 726783 - DNA, 13 bp, C. elegans
tccgcccagtttt

SEQ ID NO: 726784 - DNA, 13 bp, C. elegans
tccgccgattttt

SEQ ID NO: 726785 - DNA, 13 bp, C. elegans
tccgcgaaaaaaa

SEQ ID NO: 726786 - DNA, 13 bp, C. elegans
tccgcgctccagg

SEQ ID NO: 726787 - DNA, 13 bp, C. elegans
tccgctcattttt

SEQ ID NO: 726788 - DNA, 13 bp, C. elegans
tccgctctaccaa

SEQ ID NO: 726789 - DNA, 13 bp, C. elegans
tccgctctgaaaa

SEQ ID NO: 726790 - DNA, 13 bp, C. elegans
tccggaaaaatca

SEQ ID NO: 726791 - DNA, 13 bp, C. elegans
tccggaaaattca

SEQ ID NO: 726792 - DNA, 13 bp, C. elegans
tccggaaattttc

SEQ ID NO: 726793 - DNA, 13 bp, C. elegans
tccggaaattttg

SEQ ID NO: 726794 - DNA, 13 bp, C. elegans
tccggaatttttt

SEQ ID NO: 726795 - DNA, 13 bp, C. elegans
tccggcaaaacgg

SEQ ID NO: 726796 - DNA, 13 bp, C. elegans
tccggcaaagtgc

SEQ ID NO: 726797 - DNA, 13 bp, C. elegans
tccggcaaatcgg

SEQ ID NO: 726798 - DNA, 13 bp, C. elegans
tccggcaacttgt

SEQ ID NO: 726799 - DNA, 13 bp, C. elegans
tccggcaagttgt

SEQ ID NO: 726800 - DNA, 13 bp, C. elegans
tccggcaattgcc

SEQ ID NO: 726801 - DNA, 13 bp, C. elegans
tccggcaattttc

SEQ ID NO: 726802 - DNA, 17 bp, C. elegans
tccgggacccaatgggg

SEQ ID NO: 726803 - DNA, 13 bp, C. elegans
tccggtgacaaat

SEQ ID NO: 726804 - DNA, 13 bp, C. elegans
tccgtaaatcgac

SEQ ID NO: 726805 - DNA, 13 bp, C. elegans
tccgtcgaaaatt

SEQ ID NO: 726806 - DNA, 13 bp, C. elegans
tccgtgagatgtc

SEQ ID NO: 726807 - DNA, 13 bp, C. elegans
tccgtgatttttg

SEQ ID NO: 726808 - DNA, 13 bp, C. elegans
tccgtttaaaaat

SEQ ID NO: 726809 - DNA, 13 bp, C. elegans
tccgttttcttta

SEQ ID NO: 726810 - DNA, 13 bp, C. elegans
tccgtttttaatt

SEQ ID NO: 726811 - DNA, 13 bp, C. elegans
tcctaaaaaattc

SEQ ID NO: 726812 - DNA, 13 bp, C. elegans
tcctaaaattcaa

SEQ ID NO: 726813 - DNA, 13 bp, C. elegans
tcctaacgagacc

SEQ ID NO: 726814 - DNA, 13 bp, C. elegans
tcctaattttttg

SEQ ID NO: 726815 - DNA, 13 bp, C. elegans
tcctacaaaatgc

SEQ ID NO: 726816 - DNA, 13 bp, C. elegans
tcctacacttttt

SEQ ID NO: 726817 - DNA, 13 bp, C. elegans
tcctacagtaccc

SEQ ID NO: 726818 - DNA, 13 bp, C. elegans
tcctataaatgtt

SEQ ID NO: 726819 - DNA, 13 bp, C. elegans
tcctatagaagtt

SEQ ID NO: 726820 - DNA, 13 bp, C. elegans
tcctatagaattt

SEQ ID NO: 726821 - DNA, 13 bp, C. elegans
tcctatatttttg

SEQ ID NO: 726822 - DNA, 13 bp, C. elegans
tcctatctcatgg

SEQ ID NO: 726823 - DNA, 13 bp, C. elegans
tcctatgaatttt

SEQ ID NO: 726824 - DNA, 13 bp, C. elegans
tcctattttcaaa

SEQ ID NO: 726825 - DNA, 13 bp, C. elegans
tcctcaaaaaaat

SEQ ID NO: 726826 - DNA, 13 bp, C. elegans
tcctcaaaaaatc

SEQ ID NO: 726827 - DNA, 13 bp, C. elegans
tcctcaaaaactc

SEQ ID NO: 726828 - DNA, 13 bp, C. elegans
tcctcaaatattt

SEQ ID NO: 726829 - DNA, 13 bp, C. elegans
tcctcaatttttg

SEQ ID NO: 726830 - DNA, 13 bp, C. elegans
tcctcatcatcat

SEQ ID NO: 726831 - DNA, 13 bp, C. elegans
tcctcattgaatt

SEQ ID NO: 726832 - DNA, 13 bp, C. elegans
tcctcattttcat

SEQ ID NO: 726833 - DNA, 13 bp, C. elegans
tcctcattttcga

SEQ ID NO: 726834 - DNA, 13 bp, C. elegans
tcctcatttttca

SEQ ID NO: 726835 - DNA, 13 bp, C. elegans
tcctccattttca

SEQ ID NO: 726836 - DNA, 13 bp, C. elegans
tcctcgaaaaaat

SEQ ID NO: 726837 - DNA, 13 bp, C. elegans
tcctcgaaatttt

SEQ ID NO: 726838 - DNA, 13 bp, C. elegans
tcctcgattttca

SEQ ID NO: 726839 - DNA, 13 bp, C. elegans
tcctcggccatgg

SEQ ID NO: 726840 - DNA, 36 bp, C. elegans
tcctcggtagtatagtggtgagtatccgcgtctgtc

SEQ ID NO: 726841 - DNA, 13 bp, C. elegans
tcctctaatagta

SEQ ID NO: 726842 - DNA, 13 bp, C. elegans
tcctctcaaaatt

SEQ ID NO: 726843 - DNA, 13 bp, C. elegans
tcctctcggacaa

SEQ ID NO: 726844 - DNA, 14 bp, C. elegans
tcctctcggacaac

SEQ ID NO: 726845 - DNA, 13 bp, C. elegans
tcctcttcaaaaa

SEQ ID NO: 726846 - DNA, 13 bp, C. elegans
tcctgaaaaatct

SEQ ID NO: 726847 - DNA, 13 bp, C. elegans
tcctgaaaaattc

SEQ ID NO: 726848 - DNA, 13 bp, C. elegans
tcctgaaaacttt

SEQ ID NO: 726849 - DNA, 13 bp, C. elegans
tcctgaaatttcc

SEQ ID NO: 726850 - DNA, 13 bp, C. elegans
tcctgagaaaaaa

SEQ ID NO: 726851 - DNA, 13 bp, C. elegans
tcctgatctcaat

SEQ ID NO: 726852 - DNA, 13 bp, C. elegans
tcctgatgatctg

SEQ ID NO: 726853 - DNA, 13 bp, C. elegans
tcctgatttattg

SEQ ID NO: 726854 - DNA, 13 bp, C. elegans
tcctgatttttta

SEQ ID NO: 726855 - DNA, 13 bp, C. elegans
tcctgctgactgc

SEQ ID NO: 726856 - DNA, 50 bp, C. elegans
tcctggattgaattgaaaggagaagctgaggattacgatacgatccctgg

SEQ ID NO: 726857 - DNA, 13 bp, C. elegans
tcctgtattttgt

SEQ ID NO: 726858 - DNA, 13 bp, C. elegans
tcctgtgattttt

SEQ ID NO: 726859 - DNA, 13 bp, C. elegans
tcctgtttgaatt

SEQ ID NO: 726860 - DNA, 13 bp, C. elegans
tccttcaaaaatt

SEQ ID NO: 726861 - DNA, 13 bp, C. elegans
tccttcccaaaat

SEQ ID NO: 726862 - DNA, 13 bp, C. elegans
tccttcttcaaaa

SEQ ID NO: 726863 - DNA, 13 bp, C. elegans
tccttgaacaccc

SEQ ID NO: 726864 - DNA, 13 bp, C. elegans
tccttgaattttg

SEQ ID NO: 726865 - DNA, 13 bp, C. elegans
tccttgtgatcct

SEQ ID NO: 726866 - DNA, 13 bp, C. elegans
tccttgttcataa

SEQ ID NO: 726867 - DNA, 13 bp, C. elegans
tcctttaaaaaaa

SEQ ID NO: 726868 - DNA, 13 bp, C. elegans
tcctttaaaaaat

SEQ ID NO: 726869 - DNA, 13 bp, C. elegans
tcctttaaaaatc

SEQ ID NO: 726870 - DNA, 13 bp, C. elegans
tcctttaaaaatt

SEQ ID NO: 726871 - DNA, 13 bp, C. elegans
tcctttattgcat

SEQ ID NO: 726872 - DNA, 13 bp, C. elegans
tcctttcaattca

SEQ ID NO: 726873 - DNA, 13 bp, C. elegans
tcctttctcaccg

SEQ ID NO: 726874 - DNA, 13 bp, C. elegans
tccttttctcaat

SEQ ID NO: 726875 - DNA, 13 bp, C. elegans
tcctttttaaaat

SEQ ID NO: 726876 - DNA, 13 bp, C. elegans
tcctttttcagtt

SEQ ID NO: 726877 - DNA, 13 bp, C. elegans
tcctttttctgaa

SEQ ID NO: 726878 - DNA, 13 bp, C. elegans
tccttttttcaaa

SEQ ID NO: 726879 - DNA, 13 bp, C. elegans
tccttttttccag

SEQ ID NO: 726880 - DNA, 13 bp, C. elegans
tccttttttgaaa

SEQ ID NO: 726881 - DNA, 13 bp, C. elegans
tccttttttgatg

SEQ ID NO: 726882 - DNA, 13 bp, C. elegans
tccttttttgcat

SEQ ID NO: 726883 - DNA, 13 bp, C. elegans
tcgaaaaaaacgt

SEQ ID NO: 726884 - DNA, 13 bp, C. elegans
tcgaaaaaaacta

SEQ ID NO: 726885 - DNA, 13 bp, C. elegans
tcgaaaaaaactt

SEQ ID NO: 726886 - DNA, 13 bp, C. elegans
tcgaaaaaaatta

SEQ ID NO: 726887 - DNA, 13 bp, C. elegans
tcgaaaaaagtgt

SEQ ID NO: 726888 - DNA, 13 bp, C. elegans
tcgaaaaaatcac

SEQ ID NO: 726889 - DNA, 13 bp, C. elegans
tcgaaaaaatcca

SEQ ID NO: 726890 - DNA, 13 bp, C. elegans
tcgaaaaaatcga

SEQ ID NO: 726891 - DNA, 13 bp, C. elegans
tcgaaaaaatgat

SEQ ID NO: 726892 - DNA, 13 bp, C. elegans
tcgaaaaaattac

SEQ ID NO: 726893 - DNA, 14 bp, C. elegans
tcgaaaaaattcaa

SEQ ID NO: 726894 - DNA, 13 bp, C. elegans
tcgaaaaaattga

SEQ ID NO: 726895 - DNA, 13 bp, C. elegans
tcgaaaaaattgg

SEQ ID NO: 726896 - DNA, 13 bp, C. elegans
tcgaaaaacacaa

SEQ ID NO: 726897 - DNA, 13 bp, C. elegans
tcgaaaaaccaat

SEQ ID NO: 726898 - DNA, 13 bp, C. elegans
tcgaaaaaccccc

SEQ ID NO: 726899 - DNA, 13 bp, C. elegans
tcgaaaaacgaac

SEQ ID NO: 726900 - DNA, 13 bp, C. elegans
tcgaaaaacgact

SEQ ID NO: 726901 - DNA, 13 bp, C. elegans
tcgaaaaactaaa

SEQ ID NO: 726902 - DNA, 13 bp, C. elegans
tcgaaaaactgga

SEQ ID NO: 726903 - DNA, 13 bp, C. elegans
tcgaaaaagaaat

SEQ ID NO: 726904 - DNA, 13 bp, C. elegans
tcgaaaaagagaa

SEQ ID NO: 726905 - DNA, 13 bp, C. elegans
tcgaaaaagttgg

SEQ ID NO: 726906 - DNA, 13 bp, C. elegans
tcgaaaaagtttc

SEQ ID NO: 726907 - DNA, 13 bp, C. elegans
tcgaaaaataaat

SEQ ID NO: 726908 - DNA, 13 bp, C. elegans
tcgaaaaatataa

SEQ ID NO: 726909 - DNA, 13 bp, C. elegans
tcgaaaaatatat

SEQ ID NO: 726910 - DNA, 13 bp, C. elegans
tcgaaaaatcaaa

SEQ ID NO: 726911 - DNA, 13 bp, C. elegans
tcgaaaaatcgat

SEQ ID NO: 726912 - DNA, 13 bp, C. elegans
tcgaaaaatcgca

SEQ ID NO: 726913 - DNA, 13 bp, C. elegans
tcgaaaaatctgg

SEQ ID NO: 726914 - DNA, 13 bp, C. elegans
tcgaaaaatgaca

SEQ ID NO: 726915 - DNA, 13 bp, C. elegans
tcgaaaaatggaa

SEQ ID NO: 726916 - DNA, 13 bp, C. elegans
tcgaaaaatggca

SEQ ID NO: 726917 - DNA, 13 bp, C. elegans
tcgaaaaatggtt

SEQ ID NO: 726918 - DNA, 13 bp, C. elegans
tcgaaaaattcaa

SEQ ID NO: 726919 - DNA, 13 bp, C. elegans
tcgaaaaattcca

SEQ ID NO: 726920 - DNA, 13 bp, C. elegans
tcgaaaaatttcg

SEQ ID NO: 726921 - DNA, 13 bp, C. elegans
tcgaaaaatttta

SEQ ID NO: 726922 - DNA, 13 bp, C. elegans
tcgaaaacaaatt

SEQ ID NO: 726923 - DNA, 13 bp, C. elegans
tcgaaaacatgtt

SEQ ID NO: 726924 - DNA, 13 bp, C. elegans
tcgaaaacatttc

SEQ ID NO: 726925 - DNA, 13 bp, C. elegans
tcgaaaacatttt

SEQ ID NO: 726926 - DNA, 13 bp, C. elegans
tcgaaaaccatca

SEQ ID NO: 726927 - DNA, 13 bp, C. elegans
tcgaaaactggaa

SEQ ID NO: 726928 - DNA, 13 bp, C. elegans
tcgaaaacttcca

SEQ ID NO: 726929 - DNA, 13 bp, C. elegans
tcgaaaacttccg

SEQ ID NO: 726930 - DNA, 13 bp, C. elegans
tcgaaaacttttc

SEQ ID NO: 726931 - DNA, 13 bp, C. elegans
tcgaaaagaaaat

SEQ ID NO: 726932 - DNA, 13 bp, C. elegans
tcgaaaagtggaa

SEQ ID NO: 726933 - DNA, 13 bp, C. elegans
tcgaaaagttttg

SEQ ID NO: 726934 - DNA, 13 bp, C. elegans
tcgaaaataaata

SEQ ID NO: 726935 - DNA, 13 bp, C. elegans
tcgaaaatacaaa

SEQ ID NO: 726936 - DNA, 13 bp, C. elegans
tcgaaaatatgtg

SEQ ID NO: 726937 - DNA, 13 bp, C. elegans
tcgaaaatcagaa

SEQ ID NO: 726938 - DNA, 13 bp, C. elegans
tcgaaaatcgaca

SEQ ID NO: 726939 - DNA, 13 bp, C. elegans
tcgaaaatcgata

SEQ ID NO: 726940 - DNA, 13 bp, C. elegans
tcgaaaatgattt

SEQ ID NO: 726941 - DNA, 13 bp, C. elegans
tcgaaaatgtgaa

SEQ ID NO: 726942 - DNA, 13 bp, C. elegans
tcgaaaatgttga

SEQ ID NO: 726943 - DNA, 13 bp, C. elegans
tcgaaaatgttgt

SEQ ID NO: 726944 - DNA, 13 bp, C. elegans
tcgaaaattaaaa

SEQ ID NO: 726945 - DNA, 13 bp, C. elegans
tcgaaaattccgg

SEQ ID NO: 726946 - DNA, 13 bp, C. elegans
tcgaaaattctaa

SEQ ID NO: 726947 - DNA, 13 bp, C. elegans
tcgaaaattgtaa

SEQ ID NO: 726948 - DNA, 13 bp, C. elegans
tcgaaaatttcaa

SEQ ID NO: 726949 - DNA, 13 bp, C. elegans
tcgaaaatttgaa

SEQ ID NO: 726950 - DNA, 13 bp, C. elegans
tcgaaaatttgca

SEQ ID NO: 726951 - DNA, 13 bp, C. elegans
tcgaaaattttcc

SEQ ID NO: 726952 - DNA, 13 bp, C. elegans
tcgaaacaaaatt

SEQ ID NO: 726953 - DNA, 13 bp, C. elegans
tcgaaacaagaaa

SEQ ID NO: 726954 - DNA, 13 bp, C. elegans
tcgaaacatgcga

SEQ ID NO: 726955 - DNA, 13 bp, C. elegans
tcgaaacatttca

SEQ ID NO: 726956 - DNA, 13 bp, C. elegans
tcgaaactatata

SEQ ID NO: 726957 - DNA, 13 bp, C. elegans
tcgaaactcgaaa

SEQ ID NO: 726958 - DNA, 13 bp, C. elegans
tcgaaagtttgaa

SEQ ID NO: 726959 - DNA, 13 bp, C. elegans
tcgaaataatttt

SEQ ID NO: 726960 - DNA, 13 bp, C. elegans
tcgaaatattgtt

SEQ ID NO: 726961 - DNA, 13 bp, C. elegans
tcgaaatcatcaa

SEQ ID NO: 726962 - DNA, 13 bp, C. elegans
tcgaaatgaaaat

SEQ ID NO: 726963 - DNA, 13 bp, C. elegans
tcgaaatggaaaa

SEQ ID NO: 726964 - DNA, 13 bp, C. elegans
tcgaaattatctt

SEQ ID NO: 726965 - DNA, 13 bp, C. elegans
tcgaaattattga

SEQ ID NO: 726966 - DNA, 13 bp, C. elegans
tcgaaattatttc

SEQ ID NO: 726967 - DNA, 13 bp, C. elegans
tcgaaattatttt

SEQ ID NO: 726968 - DNA, 13 bp, C. elegans
tcgaaattcaaaa

SEQ ID NO: 726969 - DNA, 13 bp, C. elegans
tcgaaattccaaa

SEQ ID NO: 726970 - DNA, 13 bp, C. elegans
tcgaaattcgaat

SEQ ID NO: 726971 - DNA, 13 bp, C. elegans
tcgaaattcgatt

SEQ ID NO: 726972 - DNA, 13 bp, C. elegans
tcgaaattgataa

SEQ ID NO: 726973 - DNA, 13 bp, C. elegans
tcgaaattgccga

SEQ ID NO: 726974 - DNA, 13 bp, C. elegans
tcgaaattggtta

SEQ ID NO: 726975 - DNA, 13 bp, C. elegans
tcgaaatttatca

SEQ ID NO: 726976 - DNA, 13 bp, C. elegans
tcgaaatttcaat

SEQ ID NO: 726977 - DNA, 13 bp, C. elegans
tcgaaatttcgaa

SEQ ID NO: 726978 - DNA, 13 bp, C. elegans
tcgaaattttacg

SEQ ID NO: 726979 - DNA, 13 bp, C. elegans
tcgaaattttcag

SEQ ID NO: 726980 - DNA, 13 bp, C. elegans
tcgaaattttttt

SEQ ID NO: 726981 - DNA, 13 bp, C. elegans
tcgaacaaaattt

SEQ ID NO: 726982 - DNA, 13 bp, C. elegans
tcgaacaattttc

SEQ ID NO: 726983 - DNA, 13 bp, C. elegans
tcgaacaattttt

SEQ ID NO: 726984 - DNA, 13 bp, C. elegans
tcgaacccccgtc

SEQ ID NO: 726985 - DNA, 13 bp, C. elegans
tcgaacccgcgac

SEQ ID NO: 726986 - DNA, 13 bp, C. elegans
tcgaactattttc

SEQ ID NO: 726987 - DNA, 13 bp, C. elegans
tcgaactcttcca

SEQ ID NO: 726988 - DNA, 13 bp, C. elegans
tcgaacttttttt

SEQ ID NO: 726989 - DNA, 13 bp, C. elegans
tcgaagaaaaatc

SEQ ID NO: 726990 - DNA, 13 bp, C. elegans
tcgaagaaaacga

SEQ ID NO: 726991 - DNA, 13 bp, C. elegans
tcgaagaaaagtt

SEQ ID NO: 726992 - DNA, 13 bp, C. elegans
tcgaagaaaatgt

SEQ ID NO: 726993 - DNA, 13 bp, C. elegans
tcgaagagaaaaa

SEQ ID NO: 726994 - DNA, 13 bp, C. elegans
tcgaagatcaaac

SEQ ID NO: 726995 - DNA, 13 bp, C. elegans
tcgaagtgctcga

SEQ ID NO: 726996 - DNA, 13 bp, C. elegans
tcgaagttacagt

SEQ ID NO: 726997 - DNA, 13 bp, C. elegans
tcgaagttgaggt

SEQ ID NO: 726998 - DNA, 13 bp, C. elegans
tcgaagtttttga

SEQ ID NO: 726999 - DNA, 13 bp, C. elegans
tcgaataaaaaat

SEQ ID NO: 727000 - DNA, 13 bp, C. elegans
tcgaataaattat

SEQ ID NO: 727001 - DNA, 13 bp, C. elegans
tcgaataattcaa

SEQ ID NO: 727002 - DNA, 13 bp, C. elegans
tcgaatattcaaa

SEQ ID NO: 727003 - DNA, 13 bp, C. elegans
tcgaatcaaaaaa

SEQ ID NO: 727004 - DNA, 13 bp, C. elegans
tcgaatcaaaaat

SEQ ID NO: 727005 - DNA, 13 bp, C. elegans
tcgaatgaaattt

SEQ ID NO: 727006 - DNA, 14 bp, C. elegans
tcgaatgcttggaa

SEQ ID NO: 727007 - DNA, 13 bp, C. elegans
tcgaatgtttcaa

SEQ ID NO: 727008 - DNA, 13 bp, C. elegans
tcgaattattttt

SEQ ID NO: 727009 - DNA, 13 bp, C. elegans
tcgaattcagcgc

SEQ ID NO: 727010 - DNA, 13 bp, C. elegans
tcgaattcctcgt

SEQ ID NO: 727011 - DNA, 13 bp, C. elegans
tcgaattctccat

SEQ ID NO: 727012 - DNA, 13 bp, C. elegans
tcgaattctccgc

SEQ ID NO: 727013 - DNA, 13 bp, C. elegans
tcgaattctgtac

SEQ ID NO: 727014 - DNA, 13 bp, C. elegans
tcgaatttaacaa

SEQ ID NO: 727015 - DNA, 13 bp, C. elegans
tcgaatttaattt

SEQ ID NO: 727016 - DNA, 13 bp, C. elegans
tcgaatttcaaga

SEQ ID NO: 727017 - DNA, 13 bp, C. elegans
tcgaatttccatt

SEQ ID NO: 727018 - DNA, 13 bp, C. elegans
tcgaatttcgcaa

SEQ ID NO: 727019 - DNA, 13 bp, C. elegans
tcgaatttctaca

SEQ ID NO: 727020 - DNA, 13 bp, C. elegans
tcgaatttctgaa

SEQ ID NO: 727021 - DNA, 13 bp, C. elegans
tcgaatttcttga

SEQ ID NO: 727022 - DNA, 13 bp, C. elegans
tcgaatttctttg

SEQ ID NO: 727023 - DNA, 13 bp, C. elegans
tcgaatttgtttc

SEQ ID NO: 727024 - DNA, 13 bp, C. elegans
tcgaattttatga

SEQ ID NO: 727025 - DNA, 13 bp, C. elegans
tcgaattttcaag

SEQ ID NO: 727026 - DNA, 13 bp, C. elegans
tcgaattttcaca

SEQ ID NO: 727027 - DNA, 13 bp, C. elegans
tcgaattttcatt

SEQ ID NO: 727028 - DNA, 13 bp, C. elegans
tcgaattttccag

SEQ ID NO: 727029 - DNA, 13 bp, C. elegans
tcgaattttccca

SEQ ID NO: 727030 - DNA, 13 bp, C. elegans
tcgaattttcctt

SEQ ID NO: 727031 - DNA, 13 bp, C. elegans
tcgaattttcgca

SEQ ID NO: 727032 - DNA, 13 bp, C. elegans
tcgaattttcgct

SEQ ID NO: 727033 - DNA, 13 bp, C. elegans
tcgaattttctag

SEQ ID NO: 727034 - DNA, 13 bp, C. elegans
tcgaattttctca

SEQ ID NO: 727035 - DNA, 13 bp, C. elegans
tcgaattttgagt

SEQ ID NO: 727036 - DNA, 13 bp, C. elegans
tcgaattttgttt

SEQ ID NO: 727037 - DNA, 13 bp, C. elegans
tcgaatttttcaa

SEQ ID NO: 727038 - DNA, 13 bp, C. elegans
tcgaatttttggc

SEQ ID NO: 727039 - DNA, 13 bp, C. elegans
tcgaatttttgtg

SEQ ID NO: 727040 - DNA, 13 bp, C. elegans
tcgaattttttga

SEQ ID NO: 727041 - DNA, 13 bp, C. elegans
tcgaattttttta

SEQ ID NO: 727042 - DNA, 13 bp, C. elegans
tcgacaaaaatcg

SEQ ID NO: 727043 - DNA, 13 bp, C. elegans
tcgacaaaaatgg

SEQ ID NO: 727044 - DNA, 13 bp, C. elegans
tcgacaaattgcc

SEQ ID NO: 727045 - DNA, 13 bp, C. elegans
tcgacaaattggc

SEQ ID NO: 727046 - DNA, 13 bp, C. elegans
tcgacacaaaaac

SEQ ID NO: 727047 - DNA, 13 bp, C. elegans
tcgacacaagcac

SEQ ID NO: 727048 - DNA, 13 bp, C. elegans
tcgacacgaaaat

SEQ ID NO: 727049 - DNA, 13 bp, C. elegans
tcgacattaaaaa

SEQ ID NO: 727050 - DNA, 13 bp, C. elegans
tcgacattttcaa

SEQ ID NO: 727051 - DNA, 13 bp, C. elegans
tcgacatttttct

SEQ ID NO: 727052 - DNA, 13 bp, C. elegans
tcgacgaaaagtt

SEQ ID NO: 727053 - DNA, 13 bp, C. elegans
tcgacgaaaatcg

SEQ ID NO: 727054 - DNA, 13 bp, C. elegans
tcgacgaaattaa

SEQ ID NO: 727055 - DNA, 13 bp, C. elegans
tcgacgaattttt

SEQ ID NO: 727056 - DNA, 13 bp, C. elegans
tcgacgcgcaaaa

SEQ ID NO: 727057 - DNA, 13 bp, C. elegans
tcgactgaaaatt

SEQ ID NO: 727058 - DNA, 13 bp, C. elegans
tcgactttttcaa

SEQ ID NO: 727059 - DNA, 13 bp, C. elegans
tcgacttttttgt

SEQ ID NO: 727060 - DNA, 13 bp, C. elegans
tcgagaaaaatct

SEQ ID NO: 727061 - DNA, 13 bp, C. elegans
tcgagaaaaatga

SEQ ID NO: 727062 - DNA, 13 bp, C. elegans
tcgagaaaaatgt

SEQ ID NO: 727063 - DNA, 13 bp, C. elegans
tcgagaaaacaaa

SEQ ID NO: 727064 - DNA, 13 bp, C. elegans
tcgagaaaataat

SEQ ID NO: 727065 - DNA, 13 bp, C. elegans
tcgagaaaattcc

SEQ ID NO: 727066 - DNA, 13 bp, C. elegans
tcgagaaaatttc

SEQ ID NO: 727067 - DNA, 13 bp, C. elegans
tcgagaaatcgaa

SEQ ID NO: 727068 - DNA, 13 bp, C. elegans
tcgagaaatttga

SEQ ID NO: 727069 - DNA, 13 bp, C. elegans
tcgagaaatttta

SEQ ID NO: 727070 - DNA, 13 bp, C. elegans
tcgagaagaaaaa

SEQ ID NO: 727071 - DNA, 13 bp, C. elegans
tcgagaattaatt

SEQ ID NO: 727072 - DNA, 13 bp, C. elegans
tcgagaatttcaa

SEQ ID NO: 727073 - DNA, 13 bp, C. elegans
tcgagaatttctg

SEQ ID NO: 727074 - DNA, 13 bp, C. elegans
tcgagacccatct

SEQ ID NO: 727075 - DNA, 13 bp, C. elegans
tcgagataaagtt

SEQ ID NO: 727076 - DNA, 13 bp, C. elegans
tcgagattttgaa

SEQ ID NO: 727077 - DNA, 13 bp, C. elegans
tcgagattttggc

SEQ ID NO: 727078 - DNA, 13 bp, C. elegans
tcgagatttttac

SEQ ID NO: 727079 - DNA, 13 bp, C. elegans
tcgagcaaaaatt

SEQ ID NO: 727080 - DNA, 13 bp, C. elegans
tcgagcaccttga

SEQ ID NO: 727081 - DNA, 13 bp, C. elegans
tcgagcattcaaa

SEQ ID NO: 727082 - DNA, 13 bp, C. elegans
tcgagcatttttg

SEQ ID NO: 727083 - DNA, 13 bp, C. elegans
tcgagccaatttt

SEQ ID NO: 727084 - DNA, 13 bp, C. elegans
tcgagctttttca

SEQ ID NO: 727085 - DNA, 13 bp, C. elegans
tcgaggaattttt

SEQ ID NO: 727086 - DNA, 13 bp, C. elegans
tcgaggagaagtg

SEQ ID NO: 727087 - DNA, 14 bp, C. elegans
tcgagtacaacaga

SEQ ID NO: 727088 - DNA, 13 bp, C. elegans
tcgagtcgatcag

SEQ ID NO: 727089 - DNA, 13 bp, C. elegans
tcgagtgtttttt

SEQ ID NO: 727090 - DNA, 13 bp, C. elegans
tcgagttttcttt

SEQ ID NO: 727091 - DNA, 13 bp, C. elegans
tcgagtttttcaa

SEQ ID NO: 727092 - DNA, 13 bp, C. elegans
tcgagtttttccg

SEQ ID NO: 727093 - DNA, 13 bp, C. elegans
tcgataaaaaata

SEQ ID NO: 727094 - DNA, 13 bp, C. elegans
tcgataaaaatcg

SEQ ID NO: 727095 - DNA, 13 bp, C. elegans
tcgataaataaat

SEQ ID NO: 727096 - DNA, 13 bp, C. elegans
tcgataaatattt

SEQ ID NO: 727097 - DNA, 13 bp, C. elegans
tcgataacttttc

SEQ ID NO: 727098 - DNA, 13 bp, C. elegans
tcgataataattt

SEQ ID NO: 727099 - DNA, 13 bp, C. elegans
tcgataattttac

SEQ ID NO: 727100 - DNA, 13 bp, C. elegans
tcgataattttat

SEQ ID NO: 727101 - DNA, 13 bp, C. elegans
tcgataattttcg

SEQ ID NO: 727102 - DNA, 13 bp, C. elegans
tcgatatatattt

SEQ ID NO: 727103 - DNA, 13 bp, C. elegans
tcgatattcaatt

SEQ ID NO: 727104 - DNA, 13 bp, C. elegans
tcgatattggaaa

SEQ ID NO: 727105 - DNA, 13 bp, C. elegans
tcgatatttattt

SEQ ID NO: 727106 - DNA, 13 bp, C. elegans
tcgatattttctt

SEQ ID NO: 727107 - DNA, 13 bp, C. elegans
tcgatattttgaa

SEQ ID NO: 727108 - DNA, 13 bp, C. elegans
tcgatcaaaaaaa

SEQ ID NO: 727109 - DNA, 13 bp, C. elegans
tcgatcgattttt

SEQ ID NO: 727110 - DNA, 13 bp, C. elegans
tcgatctaaaaat

SEQ ID NO: 727111 - DNA, 13 bp, C. elegans
tcgatctgaaaat

SEQ ID NO: 727112 - DNA, 13 bp, C. elegans
tcgatctgaaact

SEQ ID NO: 727113 - DNA, 13 bp, C. elegans
tcgatgaaaattc

SEQ ID NO: 727114 - DNA, 13 bp, C. elegans
tcgatgaaatttt

SEQ ID NO: 727115 - DNA, 13 bp, C. elegans
tcgatgaagtttc

SEQ ID NO: 727116 - DNA, 13 bp, C. elegans
tcgatgagcatgg

SEQ ID NO: 727117 - DNA, 13 bp, C. elegans
tcgatgcaccatg

SEQ ID NO: 727118 - DNA, 13 bp, C. elegans
tcgatgtgacgaa

SEQ ID NO: 727119 - DNA, 13 bp, C. elegans
tcgattatttgaa

SEQ ID NO: 727120 - DNA, 13 bp, C. elegans
tcgattattttca

SEQ ID NO: 727121 - DNA, 13 bp, C. elegans
tcgattattttga

SEQ ID NO: 727122 - DNA, 13 bp, C. elegans
tcgattattttta

SEQ ID NO: 727123 - DNA, 13 bp, C. elegans
tcgattatttttg

SEQ ID NO: 727124 - DNA, 13 bp, C. elegans
tcgattgataaat

SEQ ID NO: 727125 - DNA, 13 bp, C. elegans
tcgattggttttt

SEQ ID NO: 727126 - DNA, 13 bp, C. elegans
tcgatttacagga

SEQ ID NO: 727127 - DNA, 13 bp, C. elegans
tcgatttacgggc

SEQ ID NO: 727128 - DNA, 13 bp, C. elegans
tcgatttaggtat

SEQ ID NO: 727129 - DNA, 13 bp, C. elegans
tcgatttatcgat

SEQ ID NO: 727130 - DNA, 13 bp, C. elegans
tcgatttccaatt

SEQ ID NO: 727131 - DNA, 13 bp, C. elegans
tcgatttcgaatc

SEQ ID NO: 727132 - DNA, 13 bp, C. elegans
tcgatttgctgga

SEQ ID NO: 727133 - DNA, 13 bp, C. elegans
tcgattttatttc

SEQ ID NO: 727134 - DNA, 13 bp, C. elegans
tcgattttcactg

SEQ ID NO: 727135 - DNA, 13 bp, C. elegans
tcgattttcactt

SEQ ID NO: 727136 - DNA, 13 bp, C. elegans
tcgattttcagcc

SEQ ID NO: 727137 - DNA, 13 bp, C. elegans
tcgattttcagcg

SEQ ID NO: 727138 - DNA, 13 bp, C. elegans
tcgattttcagtg

SEQ ID NO: 727139 - DNA, 13 bp, C. elegans
tcgattttcatca

SEQ ID NO: 727140 - DNA, 13 bp, C. elegans
tcgattttcatga

SEQ ID NO: 727141 - DNA, 13 bp, C. elegans
tcgattttccctc

SEQ ID NO: 727142 - DNA, 13 bp, C. elegans
tcgattttcgaga

SEQ ID NO: 727143 - DNA, 13 bp, C. elegans
tcgattttctatt

SEQ ID NO: 727144 - DNA, 13 bp, C. elegans
tcgattttctcac

SEQ ID NO: 727145 - DNA, 13 bp, C. elegans
tcgattttctgat

SEQ ID NO: 727146 - DNA, 13 bp, C. elegans
tcgattttgagct

SEQ ID NO: 727147 - DNA, 13 bp, C. elegans
tcgatttttaagc

SEQ ID NO: 727148 - DNA, 13 bp, C. elegans
tcgatttttaatc

SEQ ID NO: 727149 - DNA, 13 bp, C. elegans
tcgatttttactc

SEQ ID NO: 727150 - DNA, 13 bp, C. elegans
tcgatttttatat

SEQ ID NO: 727151 - DNA, 13 bp, C. elegans
tcgatttttcaac

SEQ ID NO: 727152 - DNA, 13 bp, C. elegans
tcgatttttcaca

SEQ ID NO: 727153 - DNA, 13 bp, C. elegans
tcgatttttccta

SEQ ID NO: 727154 - DNA, 13 bp, C. elegans
tcgatttttcgaa

SEQ ID NO: 727155 - DNA, 13 bp, C. elegans
tcgatttttcgga

SEQ ID NO: 727156 - DNA, 13 bp, C. elegans
tcgatttttctag

SEQ ID NO: 727157 - DNA, 13 bp, C. elegans
tcgatttttcttg

SEQ ID NO: 727158 - DNA, 13 bp, C. elegans
tcgatttttgaaa

SEQ ID NO: 727159 - DNA, 13 bp, C. elegans
tcgatttttgatt

SEQ ID NO: 727160 - DNA, 13 bp, C. elegans
tcgatttttgcat

SEQ ID NO: 727161 - DNA, 13 bp, C. elegans
tcgatttttggaa

SEQ ID NO: 727162 - DNA, 13 bp, C. elegans
tcgatttttggcg

SEQ ID NO: 727163 - DNA, 13 bp, C. elegans
tcgattttttata

SEQ ID NO: 727164 - DNA, 13 bp, C. elegans
tcgattttttatc

SEQ ID NO: 727165 - DNA, 13 bp, C. elegans
tcgattttttcac

SEQ ID NO: 727166 - DNA, 13 bp, C. elegans
tcgattttttccg

SEQ ID NO: 727167 - DNA, 13 bp, C. elegans
tcgattttttctc

SEQ ID NO: 727168 - DNA, 13 bp, C. elegans
tcgattttttgat

SEQ ID NO: 727169 - DNA, 13 bp, C. elegans
tcgattttttggt

SEQ ID NO: 727170 - DNA, 13 bp, C. elegans
tcgatttttttag

SEQ ID NO: 727171 - DNA, 13 bp, C. elegans
tcgatttttttcc

SEQ ID NO: 727172 - DNA, 13 bp, C. elegans
tcgcaaaatttca

SEQ ID NO: 727173 - DNA, 13 bp, C. elegans
tcgcaaagttgaa

SEQ ID NO: 727174 - DNA, 13 bp, C. elegans
tcgcaattttgaa

SEQ ID NO: 727175 - DNA, 13 bp, C. elegans
tcgcacaaaaagt

SEQ ID NO: 727176 - DNA, 13 bp, C. elegans
tcgcactacgttg

SEQ ID NO: 727177 - DNA, 13 bp, C. elegans
tcgcagaaaaatc

SEQ ID NO: 727178 - DNA, 13 bp, C. elegans
tcgcaggagttct

SEQ ID NO: 727179 - DNA, 13 bp, C. elegans
tcgcataaatttt

SEQ ID NO: 727180 - DNA, 13 bp, C. elegans
tcgcattttcaat

SEQ ID NO: 727181 - DNA, 13 bp, C. elegans
tcgcattttctcc

SEQ ID NO: 727182 - DNA, 13 bp, C. elegans
tcgcatttttctg

SEQ ID NO: 727183 - DNA, 13 bp, C. elegans
tcgccaaaaaatt

SEQ ID NO: 727184 - DNA, 13 bp, C. elegans
tcgccaacttttc

SEQ ID NO: 727185 - DNA, 13 bp, C. elegans
tcgccacgaaaaa

SEQ ID NO: 727186 - DNA, 13 bp, C. elegans
tcgccagaaagat

SEQ ID NO: 727187 - DNA, 13 bp, C. elegans
tcgcccaaaaaaa

SEQ ID NO: 727188 - DNA, 13 bp, C. elegans
tcgcccatttttc

SEQ ID NO: 727189 - DNA, 13 bp, C. elegans
tcgccgaaaattt

SEQ ID NO: 727190 - DNA, 13 bp, C. elegans
tcgccgaatttca

SEQ ID NO: 727191 - DNA, 13 bp, C. elegans
tcgccgagctcgg

SEQ ID NO: 727192 - DNA, 13 bp, C. elegans
tcgccgatttgcc

SEQ ID NO: 727193 - DNA, 13 bp, C. elegans
tcgccgttcgccg

SEQ ID NO: 727194 - DNA, 13 bp, C. elegans
tcgcctaaatttt

SEQ ID NO: 727195 - DNA, 13 bp, C. elegans
tcgcctcatttct

SEQ ID NO: 727196 - DNA, 13 bp, C. elegans
tcgcgaaattttc

SEQ ID NO: 727197 - DNA, 13 bp, C. elegans
tcgcgattttcat

SEQ ID NO: 727198 - DNA, 13 bp, C. elegans
tcgcggaaaattt

SEQ ID NO: 727199 - DNA, 13 bp, C. elegans
tcgcggcgagacc

SEQ ID NO: 727200 - DNA, 13 bp, C. elegans
tcgcgtcgagacc

SEQ ID NO: 727201 - DNA, 13 bp, C. elegans
tcgcgtcgcggtc

SEQ ID NO: 727202 - DNA, 13 bp, C. elegans
tcgcgtgaaattc

SEQ ID NO: 727203 - DNA, 13 bp, C. elegans
tcgctcaaatttt

SEQ ID NO: 727204 - DNA, 13 bp, C. elegans
tcgctcaattttc

SEQ ID NO: 727205 - DNA, 13 bp, C. elegans
tcgctccgcccat

SEQ ID NO: 727206 - DNA, 13 bp, C. elegans
tcgctgaaaaata

SEQ ID NO: 727207 - DNA, 13 bp, C. elegans
tcgctgaaaattg

SEQ ID NO: 727208 - DNA, 13 bp, C. elegans
tcgctgattggtc

SEQ ID NO: 727209 - DNA, 17 bp, C. elegans
tcgctgcgaaaggagat

SEQ ID NO: 727210 - DNA, 13 bp, C. elegans
tcgctgcgagacc

SEQ ID NO: 727211 - DNA, 13 bp, C. elegans
tcgctgcgggacc

SEQ ID NO: 727212 - DNA, 13 bp, C. elegans
tcgctgtgagacc

SEQ ID NO: 727213 - DNA, 13 bp, C. elegans
tcgcttcaaaaaa

SEQ ID NO: 727214 - DNA, 13 bp, C. elegans
tcgcttcaagacc

SEQ ID NO: 727215 - DNA, 13 bp, C. elegans
tcgcttcgagacc

SEQ ID NO: 727216 - DNA, 13 bp, C. elegans
tcgcttcttttca

SEQ ID NO: 727217 - DNA, 13 bp, C. elegans
tcgcttcttttta

SEQ ID NO: 727218 - DNA, 13 bp, C. elegans
tcgctttagaaat

SEQ ID NO: 727219 - DNA, 13 bp, C. elegans
tcgctttgagaat

SEQ ID NO: 727220 - DNA, 13 bp, C. elegans
tcggaaaaaaatc

SEQ ID NO: 727221 - DNA, 13 bp, C. elegans
tcggaaaaatggc

SEQ ID NO: 727222 - DNA, 13 bp, C. elegans
tcggaaaaattga

SEQ ID NO: 727223 - DNA, 13 bp, C. elegans
tcggaaaaattgt

SEQ ID NO: 727224 - DNA, 13 bp, C. elegans
tcggaaaacgaaa

SEQ ID NO: 727225 - DNA, 13 bp, C. elegans
tcggaaaataaaa

SEQ ID NO: 727226 - DNA, 13 bp, C. elegans
tcggaaaattgaa

SEQ ID NO: 727227 - DNA, 13 bp, C. elegans
tcggaaaattgtg

SEQ ID NO: 727228 - DNA, 13 bp, C. elegans
tcggaaaatttat

SEQ ID NO: 727229 - DNA, 13 bp, C. elegans
tcggaaaatttcc

SEQ ID NO: 727230 - DNA, 13 bp, C. elegans
tcggaaaatttga

SEQ ID NO: 727231 - DNA, 13 bp, C. elegans
tcggaaaattttt

SEQ ID NO: 727232 - DNA, 13 bp, C. elegans
tcggaaatcgaaa

SEQ ID NO: 727233 - DNA, 13 bp, C. elegans
tcggaaattgatt

SEQ ID NO: 727234 - DNA, 13 bp, C. elegans
tcggaaattttca

SEQ ID NO: 727235 - DNA, 13 bp, C. elegans
tcggaacattttt

SEQ ID NO: 727236 - DNA, 13 bp, C. elegans
tcggaactcaaaa

SEQ ID NO: 727237 - DNA, 15 bp, C. elegans
tcggaagaatcagaa

SEQ ID NO: 727238 - DNA, 13 bp, C. elegans
tcggaagttttca

SEQ ID NO: 727239 - DNA, 13 bp, C. elegans
tcggaatgaaggc

SEQ ID NO: 727240 - DNA, 13 bp, C. elegans
tcggaatttattt

SEQ ID NO: 727241 - DNA, 13 bp, C. elegans
tcggaatttcaaa

SEQ ID NO: 727242 - DNA, 13 bp, C. elegans
tcggaattttcga

SEQ ID NO: 727243 - DNA, 13 bp, C. elegans
tcggaattttgga

SEQ ID NO: 727244 - DNA, 13 bp, C. elegans
tcggacatgcgga

SEQ ID NO: 727245 - DNA, 13 bp, C. elegans
tcggagaaaaaac

SEQ ID NO: 727246 - DNA, 13 bp, C. elegans
tcggagcatcgtt

SEQ ID NO: 727247 - DNA, 15 bp, C. elegans
tcggagccaattttt

SEQ ID NO: 727248 - DNA, 13 bp, C. elegans
tcggataaaaatt

SEQ ID NO: 727249 - DNA, 13 bp, C. elegans
tcggattcagcat

SEQ ID NO: 727250 - DNA, 13 bp, C. elegans
tcggatttttgtt

SEQ ID NO: 727251 - DNA, 13 bp, C. elegans
tcggcaaaaaact

SEQ ID NO: 727252 - DNA, 13 bp, C. elegans
tcggcaaaagtac

SEQ ID NO: 727253 - DNA, 13 bp, C. elegans
tcggcaaatggca

SEQ ID NO: 727254 - DNA, 13 bp, C. elegans
tcggcaaattctt

SEQ ID NO: 727255 - DNA, 13 bp, C. elegans
tcggcaaattgcc

SEQ ID NO: 727256 - DNA, 13 bp, C. elegans
tcggcaactcggc

SEQ ID NO: 727257 - DNA, 13 bp, C. elegans
tcggcaacttttc

SEQ ID NO: 727258 - DNA, 13 bp, C. elegans
tcggcaacttttt

SEQ ID NO: 727259 - DNA, 13 bp, C. elegans
tcggcaatgtgcc

SEQ ID NO: 727260 - DNA, 13 bp, C. elegans
tcggcaattcccg

SEQ ID NO: 727261 - DNA, 13 bp, C. elegans
tcggcaattgctg

SEQ ID NO: 727262 - DNA, 13 bp, C. elegans
tcggcaattttga

SEQ ID NO: 727263 - DNA, 13 bp, C. elegans
tcggcagtttttc

SEQ ID NO: 727264 - DNA, 13 bp, C. elegans
tcggcatttgccg

SEQ ID NO: 727265 - DNA, 13 bp, C. elegans
tcggcccaaaatc

SEQ ID NO: 727266 - DNA, 13 bp, C. elegans
tcggccgtgtact

SEQ ID NO: 727267 - DNA, 13 bp, C. elegans
tcggcgagttttg

SEQ ID NO: 727268 - DNA, 14 bp, C. elegans
tcggcgatcgccga

SEQ ID NO: 727269 - DNA, 13 bp, C. elegans
tcggcgatttcaa

SEQ ID NO: 727270 - DNA, 13 bp, C. elegans
tcggcgtcagccg

SEQ ID NO: 727271 - DNA, 13 bp, C. elegans
tcggctaatatta

SEQ ID NO: 727272 - DNA, 15 bp, C. elegans
tcggctaattcaact

SEQ ID NO: 727273 - DNA, 13 bp, C. elegans
tcggctgatggag

SEQ ID NO: 727274 - DNA, 13 bp, C. elegans
tcgggaaaccggc

SEQ ID NO: 727275 - DNA, 14 bp, C. elegans
tcgggatggatcgg

SEQ ID NO: 727276 - DNA, 13 bp, C. elegans
tcgggtgcaatac

SEQ ID NO: 727277 - DNA, 13 bp, C. elegans
tcgggttacggta

SEQ ID NO: 727278 - DNA, 13 bp, C. elegans
tcggtaaatttgc

SEQ ID NO: 727279 - DNA, 13 bp, C. elegans
tcggtaacttgcc

SEQ ID NO: 727280 - DNA, 13 bp, C. elegans
tcggtcaattttt

SEQ ID NO: 727281 - DNA, 13 bp, C. elegans
tcggtcatttttt

SEQ ID NO: 727282 - DNA, 13 bp, C. elegans
tcggtgaaaaagt

SEQ ID NO: 727283 - DNA, 13 bp, C. elegans
tcggtgaaaatcg

SEQ ID NO: 727284 - DNA, 13 bp, C. elegans
tcggtggtttttc

SEQ ID NO: 727285 - DNA, 13 bp, C. elegans
tcggtgtaatttg

SEQ ID NO: 727286 - DNA, 13 bp, C. elegans
tcggtgtttgcgt

SEQ ID NO: 727287 - DNA, 13 bp, C. elegans
tcggttactgtag

SEQ ID NO: 727288 - DNA, 13 bp, C. elegans
tcggttattttgg

SEQ ID NO: 727289 - DNA, 13 bp, C. elegans
tcggttatttttg

SEQ ID NO: 727290 - DNA, 13 bp, C. elegans
tcggtttattttg

SEQ ID NO: 727291 - DNA, 14 bp, C. elegans
tcggtttgatctac

SEQ ID NO: 727292 - DNA, 13 bp, C. elegans
tcggtttttgaga

SEQ ID NO: 727293 - DNA, 13 bp, C. elegans
tcggttttttaat

SEQ ID NO: 727294 - DNA, 13 bp, C. elegans
tcgtaaatcgaca

SEQ ID NO: 727295 - DNA, 13 bp, C. elegans
tcgtaaattatca

SEQ ID NO: 727296 - DNA, 13 bp, C. elegans
tcgtaaatttgaa

SEQ ID NO: 727297 - DNA, 13 bp, C. elegans
tcgtaagattcgg

SEQ ID NO: 727298 - DNA, 13 bp, C. elegans
tcgtagtgagacc

SEQ ID NO: 727299 - DNA, 13 bp, C. elegans
tcgtataaatttt

SEQ ID NO: 727300 - DNA, 13 bp, C. elegans
tcgtatttctgtt

SEQ ID NO: 727301 - DNA, 13 bp, C. elegans
tcgtatttttcca

SEQ ID NO: 727302 - DNA, 13 bp, C. elegans
tcgtcaaaaaaat

SEQ ID NO: 727303 - DNA, 13 bp, C. elegans
tcgtcaaattgcc

SEQ ID NO: 727304 - DNA, 13 bp, C. elegans
tcgtcaaatttca

SEQ ID NO: 727305 - DNA, 13 bp, C. elegans
tcgtcactttccc

SEQ ID NO: 727306 - DNA, 13 bp, C. elegans
tcgtcatcatcat

SEQ ID NO: 727307 - DNA, 13 bp, C. elegans
tcgtcatttttgt

SEQ ID NO: 727308 - DNA, 13 bp, C. elegans
tcgtcattttttc

SEQ ID NO: 727309 - DNA, 14 bp, C. elegans
tcgtccactcacgg

SEQ ID NO: 727310 - DNA, 13 bp, C. elegans
tcgtcgaattgct

SEQ ID NO: 727311 - DNA, 13 bp, C. elegans
tcgtcgatttgcc

SEQ ID NO: 727312 - DNA, 13 bp, C. elegans
tcgtcgtcggatc

SEQ ID NO: 727313 - DNA, 13 bp, C. elegans
tcgtcgtcgtcgt

SEQ ID NO: 727314 - DNA, 13 bp, C. elegans
tcgtcgtcgtctt

SEQ ID NO: 727315 - DNA, 13 bp, C. elegans
tcgtcgtctgcgt

SEQ ID NO: 727316 - DNA, 13 bp, C. elegans
tcgtctcgagacc

SEQ ID NO: 727317 - DNA, 13 bp, C. elegans
tcgtctgcgtctc

SEQ ID NO: 727318 - DNA, 13 bp, C. elegans
tcgtctttatctc

SEQ ID NO: 727319 - DNA, 13 bp, C. elegans
tcgtcttttgaag

SEQ ID NO: 727320 - DNA, 13 bp, C. elegans
tcgtgaaaattct

SEQ ID NO: 727321 - DNA, 13 bp, C. elegans
tcgtgaaaattga

SEQ ID NO: 727322 - DNA, 13 bp, C. elegans
tcgtgacgagacc

SEQ ID NO: 727323 - DNA, 13 bp, C. elegans
tcgtgatgagacc

SEQ ID NO: 727324 - DNA, 13 bp, C. elegans
tcgtgatttgaaa

SEQ ID NO: 727325 - DNA, 13 bp, C. elegans
tcgtgatttttaa

SEQ ID NO: 727326 - DNA, 13 bp, C. elegans
tcgtgccaggacc

SEQ ID NO: 727327 - DNA, 13 bp, C. elegans
tcgtgccgagacc

SEQ ID NO: 727328 - DNA, 13 bp, C. elegans
tcgtgctgagacc

SEQ ID NO: 727329 - DNA, 13 bp, C. elegans
tcgtggagagacc

SEQ ID NO: 727330 - DNA, 13 bp, C. elegans
tcgtggattgctc

SEQ ID NO: 727331 - DNA, 13 bp, C. elegans
tcgtggcaagacc

SEQ ID NO: 727332 - DNA, 13 bp, C. elegans
tcgtggcgagacc

SEQ ID NO: 727333 - DNA, 13 bp, C. elegans
tcgtggcgaggcc

SEQ ID NO: 727334 - DNA, 14 bp, C. elegans
tcgtggtgagacac

SEQ ID NO: 727335 - DNA, 13 bp, C. elegans
tcgtggtgagacc

SEQ ID NO: 727336 - DNA, 15 bp, C. elegans
tcgtggtgagacgca

SEQ ID NO: 727337 - DNA, 13 bp, C. elegans
tcgtggtgagact

SEQ ID NO: 727338 - DNA, 13 bp, C. elegans
tcgtggtgaggcc

SEQ ID NO: 727339 - DNA, 13 bp, C. elegans
tcgtggtgatacc

SEQ ID NO: 727340 - DNA, 13 bp, C. elegans
tcgtggtgggacc

SEQ ID NO: 727341 - DNA, 13 bp, C. elegans
tcgtgtactcccc

SEQ ID NO: 727342 - DNA, 13 bp, C. elegans
tcgtgtcaagacc

SEQ ID NO: 727343 - DNA, 13 bp, C. elegans
tcgtgtcgagacc

SEQ ID NO: 727344 - DNA, 13 bp, C. elegans
tcgtgttcgccgt

SEQ ID NO: 727345 - DNA, 13 bp, C. elegans
tcgtgttgagacc

SEQ ID NO: 727346 - DNA, 13 bp, C. elegans
tcgtgttttttaa

SEQ ID NO: 727347 - DNA, 13 bp, C. elegans
tcgttaaaaattc

SEQ ID NO: 727348 - DNA, 13 bp, C. elegans
tcgttaaagttct

SEQ ID NO: 727349 - DNA, 13 bp, C. elegans
tcgttaggaattt

SEQ ID NO: 727350 - DNA, 13 bp, C. elegans
tcgttatcaaatt

SEQ ID NO: 727351 - DNA, 13 bp, C. elegans
tcgttatttcact

SEQ ID NO: 727352 - DNA, 13 bp, C. elegans
tcgttcacttttt

SEQ ID NO: 727353 - DNA, 13 bp, C. elegans
tcgttcatttttc

SEQ ID NO: 727354 - DNA, 13 bp, C. elegans
tcgttcgaaaaaa

SEQ ID NO: 727355 - DNA, 13 bp, C. elegans
tcgttctaaaaat

SEQ ID NO: 727356 - DNA, 13 bp, C. elegans
tcgttgaaaattc

SEQ ID NO: 727357 - DNA, 13 bp, C. elegans
tcgttgaatattt

SEQ ID NO: 727358 - DNA, 13 bp, C. elegans
tcgttgaattttc

SEQ ID NO: 727359 - DNA, 13 bp, C. elegans
tcgttgaattttt

SEQ ID NO: 727360 - DNA, 13 bp, C. elegans
tcgttgcaagacc

SEQ ID NO: 727361 - DNA, 13 bp, C. elegans
tcgttgcgagacc

SEQ ID NO: 727362 - DNA, 13 bp, C. elegans
tcgttgcgggacc

SEQ ID NO: 727363 - DNA, 13 bp, C. elegans
tcgtttaaaaaaa

SEQ ID NO: 727364 - DNA, 13 bp, C. elegans
tcgtttcaaactt

SEQ ID NO: 727365 - DNA, 13 bp, C. elegans
tcgtttcaagacc

SEQ ID NO: 727366 - DNA, 13 bp, C. elegans
tcgtttcattttc

SEQ ID NO: 727367 - DNA, 13 bp, C. elegans
tcgtttcgaaatt

SEQ ID NO: 727368 - DNA, 13 bp, C. elegans
tcgtttcgagacc

SEQ ID NO: 727369 - DNA, 13 bp, C. elegans
tcgtttctcttgc

SEQ ID NO: 727370 - DNA, 13 bp, C. elegans
tcgtttgcaaaaa

SEQ ID NO: 727371 - DNA, 13 bp, C. elegans
tcgtttgtcctat

SEQ ID NO: 727372 - DNA, 13 bp, C. elegans
tcgttttaaaaca

SEQ ID NO: 727373 - DNA, 13 bp, C. elegans
tcgttttataaat

SEQ ID NO: 727374 - DNA, 13 bp, C. elegans
tcgttttcaaaac

SEQ ID NO: 727375 - DNA, 13 bp, C. elegans
tcgttttcatcaa

SEQ ID NO: 727376 - DNA, 13 bp, C. elegans
tcgttttcggaaa

SEQ ID NO: 727377 - DNA, 13 bp, C. elegans
tcgttttcgtcaa

SEQ ID NO: 727378 - DNA, 13 bp, C. elegans
tcgttttcttcat

SEQ ID NO: 727379 - DNA, 13 bp, C. elegans
tcgttttgaaaaa

SEQ ID NO: 727380 - DNA, 13 bp, C. elegans
tcgttttgagacc

SEQ ID NO: 727381 - DNA, 13 bp, C. elegans
tcgttttggatca

SEQ ID NO: 727382 - DNA, 13 bp, C. elegans
tcgtttttcaagc

SEQ ID NO: 727383 - DNA, 13 bp, C. elegans
tcgtttttccatt

SEQ ID NO: 727384 - DNA, 13 bp, C. elegans
tcgtttttccgat

SEQ ID NO: 727385 - DNA, 13 bp, C. elegans
tcgtttttcgatt

SEQ ID NO: 727386 - DNA, 13 bp, C. elegans
tcgtttttgagaa

SEQ ID NO: 727387 - DNA, 13 bp, C. elegans
tcgttttttatca

SEQ ID NO: 727388 - DNA, 13 bp, C. elegans
tcgttttttcaaa

SEQ ID NO: 727389 - DNA, 13 bp, C. elegans
tcgttttttctca

SEQ ID NO: 727390 - DNA, 13 bp, C. elegans
tcgtttttttcca

SEQ ID NO: 727391 - DNA, 13 bp, C. elegans
tctaaaaaatctg

SEQ ID NO: 727392 - DNA, 13 bp, C. elegans
tctaaaaaccttc

SEQ ID NO: 727393 - DNA, 13 bp, C. elegans
tctaaaaactatt

SEQ ID NO: 727394 - DNA, 13 bp, C. elegans
tctaaaaactcac

SEQ ID NO: 727395 - DNA, 13 bp, C. elegans
tctaaaaatcaat

SEQ ID NO: 727396 - DNA, 13 bp, C. elegans
tctaaaaatctat

SEQ ID NO: 727397 - DNA, 13 bp, C. elegans
tctaaaaatctga

SEQ ID NO: 727398 - DNA, 13 bp, C. elegans
tctaaaaatcttc

SEQ ID NO: 727399 - DNA, 13 bp, C. elegans
tctaaaaatgttt

SEQ ID NO: 727400 - DNA, 13 bp, C. elegans
tctaaaaattcaa

SEQ ID NO: 727401 - DNA, 13 bp, C. elegans
tctaaaaattggc

SEQ ID NO: 727402 - DNA, 13 bp, C. elegans
tctaaaacatttt

SEQ ID NO: 727403 - DNA, 13 bp, C. elegans
tctaaaacttttc

SEQ ID NO: 727404 - DNA, 13 bp, C. elegans
tctaaaagttcat

SEQ ID NO: 727405 - DNA, 13 bp, C. elegans
tctaaaagtttcc

SEQ ID NO: 727406 - DNA, 13 bp, C. elegans
tctaaaatgtttt

SEQ ID NO: 727407 - DNA, 13 bp, C. elegans
tctaaaatttcaa

SEQ ID NO: 727408 - DNA, 13 bp, C. elegans
tctaaaatttcag

SEQ ID NO: 727409 - DNA, 13 bp, C. elegans
tctaaaattttcc

SEQ ID NO: 727410 - DNA, 13 bp, C. elegans
tctaaaattttgc

SEQ ID NO: 727411 - DNA, 13 bp, C. elegans
tctaaacaatttc

SEQ ID NO: 727412 - DNA, 13 bp, C. elegans
tctaaacattttt

SEQ ID NO: 727413 - DNA, 13 bp, C. elegans
tctaaacttttaa

SEQ ID NO: 727414 - DNA, 13 bp, C. elegans
tctaaagttcaaa

SEQ ID NO: 727415 - DNA, 13 bp, C. elegans
tctaaagttttct

SEQ ID NO: 727416 - DNA, 13 bp, C. elegans
tctaaataaattc

SEQ ID NO: 727417 - DNA, 13 bp, C. elegans
tctaaatctaaat

SEQ ID NO: 727418 - DNA, 13 bp, C. elegans
tctaaatctcttc

SEQ ID NO: 727419 - DNA, 13 bp, C. elegans
tctaaatgaaatt

SEQ ID NO: 727420 - DNA, 13 bp, C. elegans
tctaaattatcaa

SEQ ID NO: 727421 - DNA, 13 bp, C. elegans
tctaaattctaaa

SEQ ID NO: 727422 - DNA, 13 bp, C. elegans
tctaaatttcaat

SEQ ID NO: 727423 - DNA, 13 bp, C. elegans
tctaaatttccaa

SEQ ID NO: 727424 - DNA, 13 bp, C. elegans
tctaaatttccag

SEQ ID NO: 727425 - DNA, 13 bp, C. elegans
tctaaatttctca

SEQ ID NO: 727426 - DNA, 13 bp, C. elegans
tctaaatttcttg

SEQ ID NO: 727427 - DNA, 13 bp, C. elegans
tctaaatttgtat

SEQ ID NO: 727428 - DNA, 13 bp, C. elegans
tctaaatttgtta

SEQ ID NO: 727429 - DNA, 13 bp, C. elegans
tctaaattttcta

SEQ ID NO: 727430 - DNA, 13 bp, C. elegans
tctaaatttttga

SEQ ID NO: 727431 - DNA, 13 bp, C. elegans
tctaacaaaaatt

SEQ ID NO: 727432 - DNA, 13 bp, C. elegans
tctaacaaataat

SEQ ID NO: 727433 - DNA, 13 bp, C. elegans
tctaacaagaaaa

SEQ ID NO: 727434 - DNA, 13 bp, C. elegans
tctaacacatttt

SEQ ID NO: 727435 - DNA, 13 bp, C. elegans
tctaacatttttc

SEQ ID NO: 727436 - DNA, 13 bp, C. elegans
tctaacgaagcaa

SEQ ID NO: 727437 - DNA, 13 bp, C. elegans
tctaactatctac

SEQ ID NO: 727438 - DNA, 13 bp, C. elegans
tctaactgaaaaa

SEQ ID NO: 727439 - DNA, 13 bp, C. elegans
tctaacttcaaaa

SEQ ID NO: 727440 - DNA, 13 bp, C. elegans
tctaacttgcaat

SEQ ID NO: 727441 - DNA, 13 bp, C. elegans
tctaagaaaaaag

SEQ ID NO: 727442 - DNA, 13 bp, C. elegans
tctaagaaaattt

SEQ ID NO: 727443 - DNA, 13 bp, C. elegans
tctaataaaatcc

SEQ ID NO: 727444 - DNA, 13 bp, C. elegans
tctaataaagcaa

SEQ ID NO: 727445 - DNA, 13 bp, C. elegans
tctaataattatg

SEQ ID NO: 727446 - DNA, 13 bp, C. elegans
tctaatcaaaatc

SEQ ID NO: 727447 - DNA, 13 bp, C. elegans
tctaatctaaaaa

SEQ ID NO: 727448 - DNA, 13 bp, C. elegans
tctaattcaaaaa

SEQ ID NO: 727449 - DNA, 13 bp, C. elegans
tctaattctcttc

SEQ ID NO: 727450 - DNA, 13 bp, C. elegans
tctaattctttaa

SEQ ID NO: 727451 - DNA, 13 bp, C. elegans
tctaattgtaagc

SEQ ID NO: 727452 - DNA, 13 bp, C. elegans
tctaatttatcaa

SEQ ID NO: 727453 - DNA, 13 bp, C. elegans
tctaatttgattt

SEQ ID NO: 727454 - DNA, 13 bp, C. elegans
tctaattttcata

SEQ ID NO: 727455 - DNA, 13 bp, C. elegans
tctaattttccag

SEQ ID NO: 727456 - DNA, 13 bp, C. elegans
tctaattttctca

SEQ ID NO: 727457 - DNA, 13 bp, C. elegans
tctaattttctga

SEQ ID NO: 727458 - DNA, 13 bp, C. elegans
tctaattttgtaa

SEQ ID NO: 727459 - DNA, 13 bp, C. elegans
tctaatttttaca

SEQ ID NO: 727460 - DNA, 13 bp, C. elegans
tctaattttttcg

SEQ ID NO: 727461 - DNA, 13 bp, C. elegans
tctacaaaaaaag

SEQ ID NO: 727462 - DNA, 13 bp, C. elegans
tctacaaaaatga

SEQ ID NO: 727463 - DNA, 13 bp, C. elegans
tctacaaaaatgc

SEQ ID NO: 727464 - DNA, 13 bp, C. elegans
tctacaaaaattg

SEQ ID NO: 727465 - DNA, 13 bp, C. elegans
tctacaaaattaa

SEQ ID NO: 727466 - DNA, 13 bp, C. elegans
tctacaaagtttt

SEQ ID NO: 727467 - DNA, 13 bp, C. elegans
tctacaaatgttt

SEQ ID NO: 727468 - DNA, 13 bp, C. elegans
tctacaaattcca

SEQ ID NO: 727469 - DNA, 13 bp, C. elegans
tctacaaattgtt

SEQ ID NO: 727470 - DNA, 13 bp, C. elegans
tctacaaatttat

SEQ ID NO: 727471 - DNA, 13 bp, C. elegans
tctacaagaaatg

SEQ ID NO: 727472 - DNA, 13 bp, C. elegans
tctacaagttttc

SEQ ID NO: 727473 - DNA, 13 bp, C. elegans
tctacaatttatt

SEQ ID NO: 727474 - DNA, 13 bp, C. elegans
tctacaattttct

SEQ ID NO: 727475 - DNA, 13 bp, C. elegans
tctacagtaaccc

SEQ ID NO: 727476 - DNA, 13 bp, C. elegans
tctacagtaatcc

SEQ ID NO: 727477 - DNA, 13 bp, C. elegans
tctacagtactac

SEQ ID NO: 727478 - DNA, 13 bp, C. elegans
tctacagtactcc

SEQ ID NO: 727479 - DNA, 13 bp, C. elegans
tctacagtatccc

SEQ ID NO: 727480 - DNA, 13 bp, C. elegans
tctacatatattt

SEQ ID NO: 727481 - DNA, 13 bp, C. elegans
tctacattcaaaa

SEQ ID NO: 727482 - DNA, 13 bp, C. elegans
tctacattttcta

SEQ ID NO: 727483 - DNA, 13 bp, C. elegans
tctacattttctc

SEQ ID NO: 727484 - DNA, 13 bp, C. elegans
tctacatttttag

SEQ ID NO: 727485 - DNA, 13 bp, C. elegans
tctaccaaaacaa

SEQ ID NO: 727486 - DNA, 13 bp, C. elegans
tctaccaaaattt

SEQ ID NO: 727487 - DNA, 13 bp, C. elegans
tctaccaattttc

SEQ ID NO: 727488 - DNA, 13 bp, C. elegans
tctaccgtaatcc

SEQ ID NO: 727489 - DNA, 13 bp, C. elegans
tctaccgtacccc

SEQ ID NO: 727490 - DNA, 13 bp, C. elegans
tctaccgtactcc

SEQ ID NO: 727491 - DNA, 13 bp, C. elegans
tctacgagaatcg

SEQ ID NO: 727492 - DNA, 13 bp, C. elegans
tctacgattttgg

SEQ ID NO: 727493 - DNA, 13 bp, C. elegans
tctacgattttta

SEQ ID NO: 727494 - DNA, 13 bp, C. elegans
tctacgtctcttc

SEQ ID NO: 727495 - DNA, 13 bp, C. elegans
tctactaaatttt

SEQ ID NO: 727496 - DNA, 13 bp, C. elegans
tctactatttttg

SEQ ID NO: 727497 - DNA, 13 bp, C. elegans
tctactcaaaaat

SEQ ID NO: 727498 - DNA, 13 bp, C. elegans
tctactcattttc

SEQ ID NO: 727499 - DNA, 13 bp, C. elegans
tctactcgtattg

SEQ ID NO: 727500 - DNA, 13 bp, C. elegans
tctacttagatct

SEQ ID NO: 727501 - DNA, 13 bp, C. elegans
tctacttcatctt

SEQ ID NO: 727502 - DNA, 13 bp, C. elegans
tctacttcttcta

SEQ ID NO: 727503 - DNA, 13 bp, C. elegans
tctacttgaaaaa

SEQ ID NO: 727504 - DNA, 13 bp, C. elegans
tctactttaaaat

SEQ ID NO: 727505 - DNA, 13 bp, C. elegans
tctactttgaaaa

SEQ ID NO: 727506 - DNA, 13 bp, C. elegans
tctactttttaca

SEQ ID NO: 727507 - DNA, 13 bp, C. elegans
tctactttttcaa

SEQ ID NO: 727508 - DNA, 13 bp, C. elegans
tctactttttcac

SEQ ID NO: 727509 - DNA, 13 bp, C. elegans
tctactttttgaa

SEQ ID NO: 727510 - DNA, 13 bp, C. elegans
tctagaaaacttt

SEQ ID NO: 727511 - DNA, 13 bp, C. elegans
tctagaaaatatt

SEQ ID NO: 727512 - DNA, 13 bp, C. elegans
tctagaaaattct

SEQ ID NO: 727513 - DNA, 13 bp, C. elegans
tctagaaacttct

SEQ ID NO: 727514 - DNA, 13 bp, C. elegans
tctagaaattcca

SEQ ID NO: 727515 - DNA, 13 bp, C. elegans
tctagaacatttt

SEQ ID NO: 727516 - DNA, 13 bp, C. elegans
tctagaagttttt

SEQ ID NO: 727517 - DNA, 13 bp, C. elegans
tctagaatcttct

SEQ ID NO: 727518 - DNA, 13 bp, C. elegans
tctagaatgtttt

SEQ ID NO: 727519 - DNA, 13 bp, C. elegans
tctagaattgaaa

SEQ ID NO: 727520 - DNA, 13 bp, C. elegans
tctagaattttga

SEQ ID NO: 727521 - DNA, 13 bp, C. elegans
tctagaattttta

SEQ ID NO: 727522 - DNA, 13 bp, C. elegans
tctagaatttttg

SEQ ID NO: 727523 - DNA, 13 bp, C. elegans
tctagacattttc

SEQ ID NO: 727524 - DNA, 13 bp, C. elegans
tctagagccacaa

SEQ ID NO: 727525 - DNA, 13 bp, C. elegans
tctagattttcag

SEQ ID NO: 727526 - DNA, 13 bp, C. elegans
tctagatttttag

SEQ ID NO: 727527 - DNA, 13 bp, C. elegans
tctagattttttg

SEQ ID NO: 727528 - DNA, 13 bp, C. elegans
tctagctattttt

SEQ ID NO: 727529 - DNA, 13 bp, C. elegans
tctagcttcaaaa

SEQ ID NO: 727530 - DNA, 13 bp, C. elegans
tctaggaattttc

SEQ ID NO: 727531 - DNA, 13 bp, C. elegans
tctaggccaccat

SEQ ID NO: 727532 - DNA, 13 bp, C. elegans
tctagtacttgaa

SEQ ID NO: 727533 - DNA, 13 bp, C. elegans
tctagtctagtct

SEQ ID NO: 727534 - DNA, 13 bp, C. elegans
tctagttcaaaat

SEQ ID NO: 727535 - DNA, 13 bp, C. elegans
tctagttgaaaac

SEQ ID NO: 727536 - DNA, 13 bp, C. elegans
tctagtttgaaat

SEQ ID NO: 727537 - DNA, 13 bp, C. elegans
tctagttttcaat

SEQ ID NO: 727538 - DNA, 13 bp, C. elegans
tctagtttttgaa

SEQ ID NO: 727539 - DNA, 13 bp, C. elegans
tctataaaaattc

SEQ ID NO: 727540 - DNA, 13 bp, C. elegans
tctataaaatgta

SEQ ID NO: 727541 - DNA, 13 bp, C. elegans
tctataaacattt

SEQ ID NO: 727542 - DNA, 13 bp, C. elegans
tctataaatttgc

SEQ ID NO: 727543 - DNA, 13 bp, C. elegans
tctatatatgtat

SEQ ID NO: 727544 - DNA, 13 bp, C. elegans
tctatatcttggc

SEQ ID NO: 727545 - DNA, 13 bp, C. elegans
tctatatgtatat

SEQ ID NO: 727546 - DNA, 13 bp, C. elegans
tctatattcaaag

SEQ ID NO: 727547 - DNA, 13 bp, C. elegans
tctatcaaaaagt

SEQ ID NO: 727548 - DNA, 13 bp, C. elegans
tctatcaaaaatt

SEQ ID NO: 727549 - DNA, 13 bp, C. elegans
tctatcaaaacat

SEQ ID NO: 727550 - DNA, 13 bp, C. elegans
tctatcaagctga

SEQ ID NO: 727551 - DNA, 13 bp, C. elegans
tctatcaatctat

SEQ ID NO: 727552 - DNA, 13 bp, C. elegans
tctatcagaaaat

SEQ ID NO: 727553 - DNA, 13 bp, C. elegans
tctatcgataaat

SEQ ID NO: 727554 - DNA, 13 bp, C. elegans
tctatctaataaa

SEQ ID NO: 727555 - DNA, 13 bp, C. elegans
tctatctacaaaa

SEQ ID NO: 727556 - DNA, 13 bp, C. elegans
tctatctctatct

SEQ ID NO: 727557 - DNA, 13 bp, C. elegans
tctatcttttcaa

SEQ ID NO: 727558 - DNA, 13 bp, C. elegans
tctatgaaaaaat

SEQ ID NO: 727559 - DNA, 13 bp, C. elegans
tctatgaaatttt

SEQ ID NO: 727560 - DNA, 13 bp, C. elegans
tctatgagtcggc

SEQ ID NO: 727561 - DNA, 13 bp, C. elegans
tctatgctctctt

SEQ ID NO: 727562 - DNA, 13 bp, C. elegans
tctatggaatttt

SEQ ID NO: 727563 - DNA, 13 bp, C. elegans
tctatgttttcaa

SEQ ID NO: 727564 - DNA, 13 bp, C. elegans
tctattcaaaaac

SEQ ID NO: 727565 - DNA, 14 bp, C. elegans
tctattcaaaaatg

SEQ ID NO: 727566 - DNA, 13 bp, C. elegans
tctattcaaaatc

SEQ ID NO: 727567 - DNA, 13 bp, C. elegans
tctattcattact

SEQ ID NO: 727568 - DNA, 13 bp, C. elegans
tctattgaaaatt

SEQ ID NO: 727569 - DNA, 13 bp, C. elegans
tctattgaaataa

SEQ ID NO: 727570 - DNA, 13 bp, C. elegans
tctattgacaaaa

SEQ ID NO: 727571 - DNA, 13 bp, C. elegans
tctattgataaaa

SEQ ID NO: 727572 - DNA, 13 bp, C. elegans
tctattgattttc

SEQ ID NO: 727573 - DNA, 13 bp, C. elegans
tctattgtcaaat

SEQ ID NO: 727574 - DNA, 13 bp, C. elegans
tctatttcaaaat

SEQ ID NO: 727575 - DNA, 13 bp, C. elegans
tctatttcaatat

SEQ ID NO: 727576 - DNA, 13 bp, C. elegans
tctatttctaaaa

SEQ ID NO: 727577 - DNA, 13 bp, C. elegans
tctatttgagaaa

SEQ ID NO: 727578 - DNA, 13 bp, C. elegans
tctattttcagaa

SEQ ID NO: 727579 - DNA, 13 bp, C. elegans
tctattttctgac

SEQ ID NO: 727580 - DNA, 13 bp, C. elegans
tctatttttctgc

SEQ ID NO: 727581 - DNA, 13 bp, C. elegans
tctatttttgaat

SEQ ID NO: 727582 - DNA, 13 bp, C. elegans
tctatttttgtga

SEQ ID NO: 727583 - DNA, 13 bp, C. elegans
tctcaaaaaaagt

SEQ ID NO: 727584 - DNA, 13 bp, C. elegans
tctcaaaaaaccc

SEQ ID NO: 727585 - DNA, 13 bp, C. elegans
tctcaaaaaagta

SEQ ID NO: 727586 - DNA, 13 bp, C. elegans
tctcaaaaaagtt

SEQ ID NO: 727587 - DNA, 13 bp, C. elegans
tctcaaaaaccaa

SEQ ID NO: 727588 - DNA, 13 bp, C. elegans
tctcaaaaactac

SEQ ID NO: 727589 - DNA, 13 bp, C. elegans
tctcaaaaactat

SEQ ID NO: 727590 - DNA, 13 bp, C. elegans
tctcaaaaactga

SEQ ID NO: 727591 - DNA, 13 bp, C. elegans
tctcaaaaagaaa

SEQ ID NO: 727592 - DNA, 13 bp, C. elegans
tctcaaaaagttg

SEQ ID NO: 727593 - DNA, 13 bp, C. elegans
tctcaaaaatagt

SEQ ID NO: 727594 - DNA, 13 bp, C. elegans
tctcaaaaatcac

SEQ ID NO: 727595 - DNA, 13 bp, C. elegans
tctcaaaaatcat

SEQ ID NO: 727596 - DNA, 13 bp, C. elegans
tctcaaaaatgaa

SEQ ID NO: 727597 - DNA, 13 bp, C. elegans
tctcaaaaattct

SEQ ID NO: 727598 - DNA, 13 bp, C. elegans
tctcaaaaattgg

SEQ ID NO: 727599 - DNA, 13 bp, C. elegans
tctcaaaaattta

SEQ ID NO: 727600 - DNA, 13 bp, C. elegans
tctcaaaaatttt

SEQ ID NO: 727601 - DNA, 13 bp, C. elegans
tctcaaaactatt

SEQ ID NO: 727602 - DNA, 13 bp, C. elegans
tctcaaaagaaaa

SEQ ID NO: 727603 - DNA, 13 bp, C. elegans
tctcaaaagctca

SEQ ID NO: 727604 - DNA, 13 bp, C. elegans
tctcaaaagttct

SEQ ID NO: 727605 - DNA, 13 bp, C. elegans
tctcaaaatctaa

SEQ ID NO: 727606 - DNA, 13 bp, C. elegans
tctcaaaatcttg

SEQ ID NO: 727607 - DNA, 13 bp, C. elegans
tctcaaaatgtga

SEQ ID NO: 727608 - DNA, 13 bp, C. elegans
tctcaaaattgaa

SEQ ID NO: 727609 - DNA, 13 bp, C. elegans
tctcaaaatttgc

SEQ ID NO: 727610 - DNA, 13 bp, C. elegans
tctcaaaattttg

SEQ ID NO: 727611 - DNA, 13 bp, C. elegans
tctcaaacaattt

SEQ ID NO: 727612 - DNA, 13 bp, C. elegans
tctcaaacgtttt

SEQ ID NO: 727613 - DNA, 13 bp, C. elegans
tctcaaactattt

SEQ ID NO: 727614 - DNA, 13 bp, C. elegans
tctcaaactttta

SEQ ID NO: 727615 - DNA, 13 bp, C. elegans
tctcaaagaaaaa

SEQ ID NO: 727616 - DNA, 13 bp, C. elegans
tctcaaagttcaa

SEQ ID NO: 727617 - DNA, 13 bp, C. elegans
tctcaaataaatt

SEQ ID NO: 727618 - DNA, 13 bp, C. elegans
tctcaaatatatt

SEQ ID NO: 727619 - DNA, 13 bp, C. elegans
tctcaaatctcaa

SEQ ID NO: 727620 - DNA, 13 bp, C. elegans
tctcaaatctttc

SEQ ID NO: 727621 - DNA, 13 bp, C. elegans
tctcaaattaaaa

SEQ ID NO: 727622 - DNA, 13 bp, C. elegans
tctcaaatttcag

SEQ ID NO: 727623 - DNA, 13 bp, C. elegans
tctcaaatttcat

SEQ ID NO: 727624 - DNA, 13 bp, C. elegans
tctcaaattttac

SEQ ID NO: 727625 - DNA, 13 bp, C. elegans
tctcaaattttct

SEQ ID NO: 727626 - DNA, 13 bp, C. elegans
tctcaaattttgg

SEQ ID NO: 727627 - DNA, 13 bp, C. elegans
tctcaacaatttc

SEQ ID NO: 727628 - DNA, 13 bp, C. elegans
tctcaacagacac

SEQ ID NO: 727629 - DNA, 13 bp, C. elegans
tctcaacagtttt

SEQ ID NO: 727630 - DNA, 13 bp, C. elegans
tctcaaccaaaaa

SEQ ID NO: 727631 - DNA, 13 bp, C. elegans
tctcaactgattt

SEQ ID NO: 727632 - DNA, 13 bp, C. elegans
tctcaacttcaaa

SEQ ID NO: 727633 - DNA, 13 bp, C. elegans
tctcaactttgaa

SEQ ID NO: 727634 - DNA, 13 bp, C. elegans
tctcaacttttat

SEQ ID NO: 727635 - DNA, 13 bp, C. elegans
tctcaacttttct

SEQ ID NO: 727636 - DNA, 13 bp, C. elegans
tctcaagaaaatc

SEQ ID NO: 727637 - DNA, 13 bp, C. elegans
tctcaagaaatat

SEQ ID NO: 727638 - DNA, 13 bp, C. elegans
tctcaagttttct

SEQ ID NO: 727639 - DNA, 13 bp, C. elegans
tctcaataaattc

SEQ ID NO: 727640 - DNA, 13 bp, C. elegans
tctcaataattct

SEQ ID NO: 727641 - DNA, 13 bp, C. elegans
tctcaatattccc

SEQ ID NO: 727642 - DNA, 13 bp, C. elegans
tctcaatattttc

SEQ ID NO: 727643 - DNA, 13 bp, C. elegans
tctcaatcaattt

SEQ ID NO: 727644 - DNA, 13 bp, C. elegans
tctcaatgatttt

SEQ ID NO: 727645 - DNA, 13 bp, C. elegans
tctcaattatttc

SEQ ID NO: 727646 - DNA, 13 bp, C. elegans
tctcaattgttca

SEQ ID NO: 727647 - DNA, 13 bp, C. elegans
tctcaatttaaaa

SEQ ID NO: 727648 - DNA, 13 bp, C. elegans
tctcaatttcaaa

SEQ ID NO: 727649 - DNA, 13 bp, C. elegans
tctcaatttccag

SEQ ID NO: 727650 - DNA, 13 bp, C. elegans
tctcaatttccat

SEQ ID NO: 727651 - DNA, 13 bp, C. elegans
tctcaatttgaaa

SEQ ID NO: 727652 - DNA, 13 bp, C. elegans
tctcaatttgaat

SEQ ID NO: 727653 - DNA, 13 bp, C. elegans
tctcaatttgatt

SEQ ID NO: 727654 - DNA, 13 bp, C. elegans
tctcaatttgcaa

SEQ ID NO: 727655 - DNA, 13 bp, C. elegans
tctcaatttgcat

SEQ ID NO: 727656 - DNA, 13 bp, C. elegans
tctcaattttcag

SEQ ID NO: 727657 - DNA, 13 bp, C. elegans
tctcaattttcgc

SEQ ID NO: 727658 - DNA, 13 bp, C. elegans
tctcaattttcta

SEQ ID NO: 727659 - DNA, 13 bp, C. elegans
tctcaatttttaa

SEQ ID NO: 727660 - DNA, 13 bp, C. elegans
tctcaatttttca

SEQ ID NO: 727661 - DNA, 13 bp, C. elegans
tctcaatttttgc

SEQ ID NO: 727662 - DNA, 13 bp, C. elegans
tctcaatttttgt

SEQ ID NO: 727663 - DNA, 13 bp, C. elegans
tctcacaatcagt

SEQ ID NO: 727664 - DNA, 13 bp, C. elegans
tctcacaattttg

SEQ ID NO: 727665 - DNA, 13 bp, C. elegans
tctcacacttttc

SEQ ID NO: 727666 - DNA, 13 bp, C. elegans
tctcacagttttt

SEQ ID NO: 727667 - DNA, 13 bp, C. elegans
tctcacatttttg

SEQ ID NO: 727668 - DNA, 13 bp, C. elegans
tctcaccacgaca

SEQ ID NO: 727669 - DNA, 13 bp, C. elegans
tctcacggcgact

SEQ ID NO: 727670 - DNA, 13 bp, C. elegans
tctcactatcaga

SEQ ID NO: 727671 - DNA, 13 bp, C. elegans
tctcactctctcg

SEQ ID NO: 727672 - DNA, 13 bp, C. elegans
tctcacttcaaaa

SEQ ID NO: 727673 - DNA, 13 bp, C. elegans
tctcagaaaaatc

SEQ ID NO: 727674 - DNA, 13 bp, C. elegans
tctcagaaaatct

SEQ ID NO: 727675 - DNA, 13 bp, C. elegans
tctcagaaaatta

SEQ ID NO: 727676 - DNA, 13 bp, C. elegans
tctcagaaaattg

SEQ ID NO: 727677 - DNA, 13 bp, C. elegans
tctcagaaatgtt

SEQ ID NO: 727678 - DNA, 13 bp, C. elegans
tctcagaaattgg

SEQ ID NO: 727679 - DNA, 13 bp, C. elegans
tctcagaatattt

SEQ ID NO: 727680 - DNA, 13 bp, C. elegans
tctcagacatttt

SEQ ID NO: 727681 - DNA, 13 bp, C. elegans
tctcagattttgg

SEQ ID NO: 727682 - DNA, 13 bp, C. elegans
tctcagtcattca

SEQ ID NO: 727683 - DNA, 13 bp, C. elegans
tctcagtggagcg

SEQ ID NO: 727684 - DNA, 13 bp, C. elegans
tctcagtttctca

SEQ ID NO: 727685 - DNA, 13 bp, C. elegans
tctcagttttcac

SEQ ID NO: 727686 - DNA, 13 bp, C. elegans
tctcagttttcca

SEQ ID NO: 727687 - DNA, 13 bp, C. elegans
tctcagttttccc

SEQ ID NO: 727688 - DNA, 13 bp, C. elegans
tctcagttttttc

SEQ ID NO: 727689 - DNA, 13 bp, C. elegans
tctcataaatttt

SEQ ID NO: 727690 - DNA, 13 bp, C. elegans
tctcataatattt

SEQ ID NO: 727691 - DNA, 13 bp, C. elegans
tctcataatttat

SEQ ID NO: 727692 - DNA, 13 bp, C. elegans
tctcataattttc

SEQ ID NO: 727693 - DNA, 13 bp, C. elegans
tctcatagttttt

SEQ ID NO: 727694 - DNA, 13 bp, C. elegans
tctcatatttcgt

SEQ ID NO: 727695 - DNA, 13 bp, C. elegans
tctcatatttttg

SEQ ID NO: 727696 - DNA, 13 bp, C. elegans
tctcatcacaaaa

SEQ ID NO: 727697 - DNA, 13 bp, C. elegans
tctcatcagtttt

SEQ ID NO: 727698 - DNA, 13 bp, C. elegans
tctcatcatgaaa

SEQ ID NO: 727699 - DNA, 13 bp, C. elegans
tctcatcattttc

SEQ ID NO: 727700 - DNA, 13 bp, C. elegans
tctcatctgaaaa

SEQ ID NO: 727701 - DNA, 13 bp, C. elegans
tctcatctgattt

SEQ ID NO: 727702 - DNA, 13 bp, C. elegans
tctcatcttgatt

SEQ ID NO: 727703 - DNA, 14 bp, C. elegans
tctcatgatctcat

SEQ ID NO: 727704 - DNA, 13 bp, C. elegans
tctcattaaattt

SEQ ID NO: 727705 - DNA, 13 bp, C. elegans
tctcattacaaaa

SEQ ID NO: 727706 - DNA, 13 bp, C. elegans
tctcattacgaaa

SEQ ID NO: 727707 - DNA, 13 bp, C. elegans
tctcattattcat

SEQ ID NO: 727708 - DNA, 13 bp, C. elegans
tctcattctcaaa

SEQ ID NO: 727709 - DNA, 13 bp, C. elegans
tctcattctcatt

SEQ ID NO: 727710 - DNA, 13 bp, C. elegans
tctcattgactac

SEQ ID NO: 727711 - DNA, 13 bp, C. elegans
tctcattgatttt

SEQ ID NO: 727712 - DNA, 13 bp, C. elegans
tctcatttaaaaa

SEQ ID NO: 727713 - DNA, 13 bp, C. elegans
tctcatttcactt

SEQ ID NO: 727714 - DNA, 13 bp, C. elegans
tctcatttcattc

SEQ ID NO: 727715 - DNA, 13 bp, C. elegans
tctcatttcctca

SEQ ID NO: 727716 - DNA, 13 bp, C. elegans
tctcatttctatc

SEQ ID NO: 727717 - DNA, 13 bp, C. elegans
tctcatttctcaa

SEQ ID NO: 727718 - DNA, 13 bp, C. elegans
tctcattttcact

SEQ ID NO: 727719 - DNA, 13 bp, C. elegans
tctcattttggtt

SEQ ID NO: 727720 - DNA, 13 bp, C. elegans
tctcattttgtat

SEQ ID NO: 727721 - DNA, 13 bp, C. elegans
tctcatttttagt

SEQ ID NO: 727722 - DNA, 13 bp, C. elegans
tctcatttttcag

SEQ ID NO: 727723 - DNA, 13 bp, C. elegans
tctcatttttgta

SEQ ID NO: 727724 - DNA, 13 bp, C. elegans
tctcattttttag

SEQ ID NO: 727725 - DNA, 13 bp, C. elegans
tctcattttttgc

SEQ ID NO: 727726 - DNA, 13 bp, C. elegans
tctccaaaaaaag

SEQ ID NO: 727727 - DNA, 13 bp, C. elegans
tctccaaaaaagt

SEQ ID NO: 727728 - DNA, 13 bp, C. elegans
tctccaaaaaatg

SEQ ID NO: 727729 - DNA, 13 bp, C. elegans
tctccaaaaaatt

SEQ ID NO: 727730 - DNA, 13 bp, C. elegans
tctccaaaaactt

SEQ ID NO: 727731 - DNA, 13 bp, C. elegans
tctccaaaaatca

SEQ ID NO: 727732 - DNA, 14 bp, C. elegans
tctccaaaaatcaa

SEQ ID NO: 727733 - DNA, 13 bp, C. elegans
tctccaaaatttc

SEQ ID NO: 727734 - DNA, 13 bp, C. elegans
tctccaaatattc

SEQ ID NO: 727735 - DNA, 13 bp, C. elegans
tctccaaattttc

SEQ ID NO: 727736 - DNA, 13 bp, C. elegans
tctccaacttttc

SEQ ID NO: 727737 - DNA, 13 bp, C. elegans
tctccaattttct

SEQ ID NO: 727738 - DNA, 13 bp, C. elegans
tctccaatttttc

SEQ ID NO: 727739 - DNA, 13 bp, C. elegans
tctccacatattt

SEQ ID NO: 727740 - DNA, 13 bp, C. elegans
tctccaccaaacc

SEQ ID NO: 727741 - DNA, 13 bp, C. elegans
tctccaccaactg

SEQ ID NO: 727742 - DNA, 13 bp, C. elegans
tctccacgtcacc

SEQ ID NO: 727743 - DNA, 13 bp, C. elegans
tctccactggcgc

SEQ ID NO: 727744 - DNA, 13 bp, C. elegans
tctccagtcgatt

SEQ ID NO: 727745 - DNA, 13 bp, C. elegans
tctccatcacttt

SEQ ID NO: 727746 - DNA, 13 bp, C. elegans
tctccatttttca

SEQ ID NO: 727747 - DNA, 13 bp, C. elegans
tctccattttttg

SEQ ID NO: 727748 - DNA, 13 bp, C. elegans
tctcccaaattga

SEQ ID NO: 727749 - DNA, 13 bp, C. elegans
tctcccagttttt

SEQ ID NO: 727750 - DNA, 13 bp, C. elegans
tctccgatttttc

SEQ ID NO: 727751 - DNA, 13 bp, C. elegans
tctccgatttttt

SEQ ID NO: 727752 - DNA, 13 bp, C. elegans
tctccgcaaaaaa

SEQ ID NO: 727753 - DNA, 13 bp, C. elegans
tctccgcccactt

SEQ ID NO: 727754 - DNA, 13 bp, C. elegans
tctccgtactctg

SEQ ID NO: 727755 - DNA, 13 bp, C. elegans
tctcctaatttat

SEQ ID NO: 727756 - DNA, 13 bp, C. elegans
tctcctcaaaaat

SEQ ID NO: 727757 - DNA, 18 bp, C. elegans
tctcctcgcgagcgtaaa

SEQ ID NO: 727758 - DNA, 13 bp, C. elegans
tctcctcgggtgg

SEQ ID NO: 727759 - DNA, 13 bp, C. elegans
tctcctttcaatt

SEQ ID NO: 727760 - DNA, 13 bp, C. elegans
tctcctttcgcag

SEQ ID NO: 727761 - DNA, 13 bp, C. elegans
tctccttttcaat

SEQ ID NO: 727762 - DNA, 13 bp, C. elegans
tctcgaaaaaatg

SEQ ID NO: 727763 - DNA, 13 bp, C. elegans
tctcgaaaaatat

SEQ ID NO: 727764 - DNA, 13 bp, C. elegans
tctcgaaaaattg

SEQ ID NO: 727765 - DNA, 13 bp, C. elegans
tctcgaaaactaa

SEQ ID NO: 727766 - DNA, 13 bp, C. elegans
tctcgaaaacttc

SEQ ID NO: 727767 - DNA, 13 bp, C. elegans
tctcgaaaatcaa

SEQ ID NO: 727768 - DNA, 13 bp, C. elegans
tctcgaaaatcgt

SEQ ID NO: 727769 - DNA, 13 bp, C. elegans
tctcgaaaatctc

SEQ ID NO: 727770 - DNA, 13 bp, C. elegans
tctcgaaacgact

SEQ ID NO: 727771 - DNA, 13 bp, C. elegans
tctcgaaatattt

SEQ ID NO: 727772 - DNA, 13 bp, C. elegans
tctcgaaatttcc

SEQ ID NO: 727773 - DNA, 13 bp, C. elegans
tctcgaaattttc

SEQ ID NO: 727774 - DNA, 13 bp, C. elegans
tctcgaaattttg

SEQ ID NO: 727775 - DNA, 13 bp, C. elegans
tctcgaatgttcc

SEQ ID NO: 727776 - DNA, 13 bp, C. elegans
tctcgaattttca

SEQ ID NO: 727777 - DNA, 13 bp, C. elegans
tctcgaattttcg

SEQ ID NO: 727778 - DNA, 13 bp, C. elegans
tctcgaatttttc

SEQ ID NO: 727779 - DNA, 13 bp, C. elegans
tctcgacacgaag

SEQ ID NO: 727780 - DNA, 13 bp, C. elegans
tctcgacacgaca

SEQ ID NO: 727781 - DNA, 13 bp, C. elegans
tctcgacacgatt

SEQ ID NO: 727782 - DNA, 13 bp, C. elegans
tctcgactttttc

SEQ ID NO: 727783 - DNA, 13 bp, C. elegans
tctcgattggaag

SEQ ID NO: 727784 - DNA, 13 bp, C. elegans
tctcgattttgaa

SEQ ID NO: 727785 - DNA, 13 bp, C. elegans
tctcgatttttaa

SEQ ID NO: 727786 - DNA, 13 bp, C. elegans
tctcgatttttct

SEQ ID NO: 727787 - DNA, 13 bp, C. elegans
tctcgattttttc

SEQ ID NO: 727788 - DNA, 13 bp, C. elegans
tctcgcagcaaca

SEQ ID NO: 727789 - DNA, 13 bp, C. elegans
tctcgcagcgaaa

SEQ ID NO: 727790 - DNA, 14 bp, C. elegans
tctcgccacgacaa

SEQ ID NO: 727791 - DNA, 13 bp, C. elegans
tctcgccacgacg

SEQ ID NO: 727792 - DNA, 13 bp, C. elegans
tctcgctgtctgc

SEQ ID NO: 727793 - DNA, 13 bp, C. elegans
tctcgcttctttg

SEQ ID NO: 727794 - DNA, 19 bp, C. elegans
tctcggcttcgcctcgaac

SEQ ID NO: 727795 - DNA, 13 bp, C. elegans
tctcggtcatttt

SEQ ID NO: 727796 - DNA, 13 bp, C. elegans
tctcggttcattt

SEQ ID NO: 727797 - DNA, 13 bp, C. elegans
tctcgtagaaatg

SEQ ID NO: 727798 - DNA, 13 bp, C. elegans
tctcgtatttttc

SEQ ID NO: 727799 - DNA, 13 bp, C. elegans
tctcgtgattttt

SEQ ID NO: 727800 - DNA, 13 bp, C. elegans
tctcgtgtactcc

SEQ ID NO: 727801 - DNA, 13 bp, C. elegans
tctcgtttctctg

SEQ ID NO: 727802 - DNA, 13 bp, C. elegans
tctcgttttcaaa

SEQ ID NO: 727803 - DNA, 13 bp, C. elegans
tctcgtttttaaa

SEQ ID NO: 727804 - DNA, 13 bp, C. elegans
tctcgtttttcaa

SEQ ID NO: 727805 - DNA, 13 bp, C. elegans
tctcgttttttga

SEQ ID NO: 727806 - DNA, 13 bp, C. elegans
tctctaaaaatcc

SEQ ID NO: 727807 - DNA, 13 bp, C. elegans
tctctaaaattca

SEQ ID NO: 727808 - DNA, 13 bp, C. elegans
tctctaaactctc

SEQ ID NO: 727809 - DNA, 13 bp, C. elegans
tctctaaatctct

SEQ ID NO: 727810 - DNA, 13 bp, C. elegans
tctctaagtctct

SEQ ID NO: 727811 - DNA, 13 bp, C. elegans
tctctaataattt

SEQ ID NO: 727812 - DNA, 13 bp, C. elegans
tctctaattctca

SEQ ID NO: 727813 - DNA, 13 bp, C. elegans
tctctacaaaatg

SEQ ID NO: 727814 - DNA, 13 bp, C. elegans
tctctacattttg

SEQ ID NO: 727815 - DNA, 13 bp, C. elegans
tctctaccagaaa

SEQ ID NO: 727816 - DNA, 13 bp, C. elegans
tctctacgtctct

SEQ ID NO: 727817 - DNA, 13 bp, C. elegans
tctctagtttttc

SEQ ID NO: 727818 - DNA, 13 bp, C. elegans
tctctatctctca

SEQ ID NO: 727819 - DNA, 13 bp, C. elegans
tctctatgtctct

SEQ ID NO: 727820 - DNA, 13 bp, C. elegans
tctctatgtttct

SEQ ID NO: 727821 - DNA, 13 bp, C. elegans
tctctattaaaaa

SEQ ID NO: 727822 - DNA, 13 bp, C. elegans
tctctcaaaaaga

SEQ ID NO: 727823 - DNA, 13 bp, C. elegans
tctctcaaattct

SEQ ID NO: 727824 - DNA, 13 bp, C. elegans
tctctcaacattt

SEQ ID NO: 727825 - DNA, 13 bp, C. elegans
tctctcaatttca

SEQ ID NO: 727826 - DNA, 13 bp, C. elegans
tctctcacactct

SEQ ID NO: 727827 - DNA, 13 bp, C. elegans
tctctcagaattt

SEQ ID NO: 727828 - DNA, 13 bp, C. elegans
tctctcattttca

SEQ ID NO: 727829 - DNA, 13 bp, C. elegans
tctctcattttgt

SEQ ID NO: 727830 - DNA, 13 bp, C. elegans
tctctccaatttt

SEQ ID NO: 727831 - DNA, 13 bp, C. elegans
tctctcgaaattt

SEQ ID NO: 727832 - DNA, 13 bp, C. elegans
tctctctcttcaa

SEQ ID NO: 727833 - DNA, 13 bp, C. elegans
tctctgaaaaagt

SEQ ID NO: 727834 - DNA, 13 bp, C. elegans
tctctgaaaagat

SEQ ID NO: 727835 - DNA, 13 bp, C. elegans
tctctgaaatgtt

SEQ ID NO: 727836 - DNA, 13 bp, C. elegans
tctctgaaattga

SEQ ID NO: 727837 - DNA, 22 bp, C. elegans
tctctgagtagtatcttgcaca

SEQ ID NO: 727838 - DNA, 13 bp, C. elegans
tctctgatttctc

SEQ ID NO: 727839 - DNA, 13 bp, C. elegans
tctctgatttttg

SEQ ID NO: 727840 - DNA, 13 bp, C. elegans
tctctgcgcctcc

SEQ ID NO: 727841 - DNA, 13 bp, C. elegans
tctctgcgtctcc

SEQ ID NO: 727842 - DNA, 13 bp, C. elegans
tctctgcgtctct

SEQ ID NO: 727843 - DNA, 13 bp, C. elegans
tctctggtttcac

SEQ ID NO: 727844 - DNA, 13 bp, C. elegans
tctctgtgtctct

SEQ ID NO: 727845 - DNA, 13 bp, C. elegans
tctcttcaaaatg

SEQ ID NO: 727846 - DNA, 13 bp, C. elegans
tctcttcaaagta

SEQ ID NO: 727847 - DNA, 13 bp, C. elegans
tctcttcaactat

SEQ ID NO: 727848 - DNA, 13 bp, C. elegans
tctcttcaatttc

SEQ ID NO: 727849 - DNA, 13 bp, C. elegans
tctcttcgatttt

SEQ ID NO: 727850 - DNA, 13 bp, C. elegans
tctcttgaaaaaa

SEQ ID NO: 727851 - DNA, 13 bp, C. elegans
tctcttgaatttt

SEQ ID NO: 727852 - DNA, 13 bp, C. elegans
tctcttggaattt

SEQ ID NO: 727853 - DNA, 13 bp, C. elegans
tctctttaaaaaa

SEQ ID NO: 727854 - DNA, 13 bp, C. elegans
tctctttaaactt

SEQ ID NO: 727855 - DNA, 13 bp, C. elegans
tctctttgaaatt

SEQ ID NO: 727856 - DNA, 13 bp, C. elegans
tctcttttactac

SEQ ID NO: 727857 - DNA, 13 bp, C. elegans
tctcttttcaata

SEQ ID NO: 727858 - DNA, 13 bp, C. elegans
tctgaaaaaacta

SEQ ID NO: 727859 - DNA, 13 bp, C. elegans
tctgaaaaaagat

SEQ ID NO: 727860 - DNA, 13 bp, C. elegans
tctgaaaaaatat

SEQ ID NO: 727861 - DNA, 13 bp, C. elegans
tctgaaaaaattc

SEQ ID NO: 727862 - DNA, 13 bp, C. elegans
tctgaaaaaattt

SEQ ID NO: 727863 - DNA, 13 bp, C. elegans
tctgaaaaactga

SEQ ID NO: 727864 - DNA, 13 bp, C. elegans
tctgaaaaactgt

SEQ ID NO: 727865 - DNA, 13 bp, C. elegans
tctgaaaaagctt

SEQ ID NO: 727866 - DNA, 13 bp, C. elegans
tctgaaaaagttc

SEQ ID NO: 727867 - DNA, 13 bp, C. elegans
tctgaaaaatcaa

SEQ ID NO: 727868 - DNA, 13 bp, C. elegans
tctgaaaaatcta

SEQ ID NO: 727869 - DNA, 13 bp, C. elegans
tctgaaaaattta

SEQ ID NO: 727870 - DNA, 13 bp, C. elegans
tctgaaaacacaa

SEQ ID NO: 727871 - DNA, 13 bp, C. elegans
tctgaaaaccaaa

SEQ ID NO: 727872 - DNA, 13 bp, C. elegans
tctgaaaaccttt

SEQ ID NO: 727873 - DNA, 13 bp, C. elegans
tctgaaaactcac

SEQ ID NO: 727874 - DNA, 13 bp, C. elegans
tctgaaaagaaaa

SEQ ID NO: 727875 - DNA, 13 bp, C. elegans
tctgaaaagctca

SEQ ID NO: 727876 - DNA, 13 bp, C. elegans
tctgaaaagctgc

SEQ ID NO: 727877 - DNA, 13 bp, C. elegans
tctgaaaagcttt

SEQ ID NO: 727878 - DNA, 13 bp, C. elegans
tctgaaaagtttt

SEQ ID NO: 727879 - DNA, 13 bp, C. elegans
tctgaaaataatt

SEQ ID NO: 727880 - DNA, 13 bp, C. elegans
tctgaaaatatca

SEQ ID NO: 727881 - DNA, 13 bp, C. elegans
tctgaaaatatgg

SEQ ID NO: 727882 - DNA, 13 bp, C. elegans
tctgaaaatatta

SEQ ID NO: 727883 - DNA, 13 bp, C. elegans
tctgaaaatcgac

SEQ ID NO: 727884 - DNA, 13 bp, C. elegans
tctgaaaatgaaa

SEQ ID NO: 727885 - DNA, 13 bp, C. elegans
tctgaaaatgaac

SEQ ID NO: 727886 - DNA, 13 bp, C. elegans
tctgaaaatggat

SEQ ID NO: 727887 - DNA, 13 bp, C. elegans
tctgaaaatggga

SEQ ID NO: 727888 - DNA, 13 bp, C. elegans
tctgaaaatgtct

SEQ ID NO: 727889 - DNA, 13 bp, C. elegans
tctgaaaatgttc

SEQ ID NO: 727890 - DNA, 13 bp, C. elegans
tctgaaaattaat

SEQ ID NO: 727891 - DNA, 13 bp, C. elegans
tctgaaaattgca

SEQ ID NO: 727892 - DNA, 13 bp, C. elegans
tctgaaaattgcc

SEQ ID NO: 727893 - DNA, 13 bp, C. elegans
tctgaaaattgtt

SEQ ID NO: 727894 - DNA, 14 bp, C. elegans
tctgaaaatttgaa

SEQ ID NO: 727895 - DNA, 13 bp, C. elegans
tctgaaaattttc

SEQ ID NO: 727896 - DNA, 13 bp, C. elegans
tctgaaaattttt

SEQ ID NO: 727897 - DNA, 13 bp, C. elegans
tctgaaacaacaa

SEQ ID NO: 727898 - DNA, 13 bp, C. elegans
tctgaaacaattt

SEQ ID NO: 727899 - DNA, 13 bp, C. elegans
tctgaaacagaaa

SEQ ID NO: 727900 - DNA, 13 bp, C. elegans
tctgaaacagtaa

SEQ ID NO: 727901 - DNA, 13 bp, C. elegans
tctgaaacctttt

SEQ ID NO: 727902 - DNA, 13 bp, C. elegans
tctgaaactgaag

SEQ ID NO: 727903 - DNA, 13 bp, C. elegans
tctgaaacttcag

SEQ ID NO: 727904 - DNA, 13 bp, C. elegans
tctgaaactttct

SEQ ID NO: 727905 - DNA, 13 bp, C. elegans
tctgaaactttta

SEQ ID NO: 727906 - DNA, 13 bp, C. elegans
tctgaaagaacat

SEQ ID NO: 727907 - DNA, 13 bp, C. elegans
tctgaaagttgtt

SEQ ID NO: 727908 - DNA, 13 bp, C. elegans
tctgaaataattc

SEQ ID NO: 727909 - DNA, 13 bp, C. elegans
tctgaaatataat

SEQ ID NO: 727910 - DNA, 13 bp, C. elegans
tctgaaatatttt

SEQ ID NO: 727911 - DNA, 13 bp, C. elegans
tctgaaatcaaaa

SEQ ID NO: 727912 - DNA, 13 bp, C. elegans
tctgaaatcaaca

SEQ ID NO: 727913 - DNA, 13 bp, C. elegans
tctgaaattaatt

SEQ ID NO: 727914 - DNA, 13 bp, C. elegans
tctgaaattatgc

SEQ ID NO: 727915 - DNA, 13 bp, C. elegans
tctgaaattattt

SEQ ID NO: 727916 - DNA, 13 bp, C. elegans
tctgaaattcaat

SEQ ID NO: 727917 - DNA, 13 bp, C. elegans
tctgaaattcgag

SEQ ID NO: 727918 - DNA, 13 bp, C. elegans
tctgaaattctaa

SEQ ID NO: 727919 - DNA, 13 bp, C. elegans
tctgaaattctga

SEQ ID NO: 727920 - DNA, 13 bp, C. elegans
tctgaaattgatt

SEQ ID NO: 727921 - DNA, 13 bp, C. elegans
tctgaaattgtta

SEQ ID NO: 727922 - DNA, 13 bp, C. elegans
tctgaaatttata

SEQ ID NO: 727923 - DNA, 13 bp, C. elegans
tctgaaatttcac

SEQ ID NO: 727924 - DNA, 13 bp, C. elegans
tctgaaatttgaa

SEQ ID NO: 727925 - DNA, 13 bp, C. elegans
tctgaacaagtta

SEQ ID NO: 727926 - DNA, 13 bp, C. elegans
tctgaacatttca

SEQ ID NO: 727927 - DNA, 13 bp, C. elegans
tctgaacattttt

SEQ ID NO: 727928 - DNA, 13 bp, C. elegans
tctgaaccttttt

SEQ ID NO: 727929 - DNA, 13 bp, C. elegans
tctgaactttaaa

SEQ ID NO: 727930 - DNA, 13 bp, C. elegans
tctgaagattttc

SEQ ID NO: 727931 - DNA, 13 bp, C. elegans
tctgaagcaaata

SEQ ID NO: 727932 - DNA, 13 bp, C. elegans
tctgaagtttcaa

SEQ ID NO: 727933 - DNA, 13 bp, C. elegans
tctgaataaaatt

SEQ ID NO: 727934 - DNA, 13 bp, C. elegans
tctgaataacttt

SEQ ID NO: 727935 - DNA, 13 bp, C. elegans
tctgaataatact

SEQ ID NO: 727936 - DNA, 13 bp, C. elegans
tctgaatatctca

SEQ ID NO: 727937 - DNA, 13 bp, C. elegans
tctgaatatgaaa

SEQ ID NO: 727938 - DNA, 13 bp, C. elegans
tctgaatctccac

SEQ ID NO: 727939 - DNA, 13 bp, C. elegans
tctgaatctgaat

SEQ ID NO: 727940 - DNA, 13 bp, C. elegans
tctgaatgttttt

SEQ ID NO: 727941 - DNA, 13 bp, C. elegans
tctgaattattat

SEQ ID NO: 727942 - DNA, 13 bp, C. elegans
tctgaatttaaaa

SEQ ID NO: 727943 - DNA, 13 bp, C. elegans
tctgaatttattt

SEQ ID NO: 727944 - DNA, 13 bp, C. elegans
tctgaatttgaat

SEQ ID NO: 727945 - DNA, 13 bp, C. elegans
tctgaattttaag

SEQ ID NO: 727946 - DNA, 13 bp, C. elegans
tctgaattttgga

SEQ ID NO: 727947 - DNA, 13 bp, C. elegans
tctgacaattttc

SEQ ID NO: 727948 - DNA, 13 bp, C. elegans
tctgacatttggt

SEQ ID NO: 727949 - DNA, 13 bp, C. elegans
tctgactcatttt

SEQ ID NO: 727950 - DNA, 13 bp, C. elegans
tctgactgttttt

SEQ ID NO: 727951 - DNA, 13 bp, C. elegans
tctgacttgaaat

SEQ ID NO: 727952 - DNA, 13 bp, C. elegans
tctgagaaaagtt

SEQ ID NO: 727953 - DNA, 13 bp, C. elegans
tctgagaaacttt

SEQ ID NO: 727954 - DNA, 13 bp, C. elegans
tctgagaacattt

SEQ ID NO: 727955 - DNA, 13 bp, C. elegans
tctgagccaaaat

SEQ ID NO: 727956 - DNA, 13 bp, C. elegans
tctgataatttta

SEQ ID NO: 727957 - DNA, 13 bp, C. elegans
tctgataattttt

SEQ ID NO: 727958 - DNA, 13 bp, C. elegans
tctgatatcattt

SEQ ID NO: 727959 - DNA, 13 bp, C. elegans
tctgatctttgaa

SEQ ID NO: 727960 - DNA, 13 bp, C. elegans
tctgattattttc

SEQ ID NO: 727961 - DNA, 13 bp, C. elegans
tctgattttttag

SEQ ID NO: 727962 - DNA, 13 bp, C. elegans
tctgattttttgc

SEQ ID NO: 727963 - DNA, 13 bp, C. elegans
tctgcaaaaaaat

SEQ ID NO: 727964 - DNA, 13 bp, C. elegans
tctgcaaaaagta

SEQ ID NO: 727965 - DNA, 13 bp, C. elegans
tctgcaaaaatat

SEQ ID NO: 727966 - DNA, 13 bp, C. elegans
tctgcaaaacttt

SEQ ID NO: 727967 - DNA, 13 bp, C. elegans
tctgcaaaagaaa

SEQ ID NO: 727968 - DNA, 13 bp, C. elegans
tctgcaaattgcc

SEQ ID NO: 727969 - DNA, 13 bp, C. elegans
tctgcaagttttt

SEQ ID NO: 727970 - DNA, 13 bp, C. elegans
tctgcaattttca

SEQ ID NO: 727971 - DNA, 13 bp, C. elegans
tctgcaattttcc

SEQ ID NO: 727972 - DNA, 13 bp, C. elegans
tctgcaattttct

SEQ ID NO: 727973 - DNA, 13 bp, C. elegans
tctgcacagaaag

SEQ ID NO: 727974 - DNA, 13 bp, C. elegans
tctgcacattttt

SEQ ID NO: 727975 - DNA, 13 bp, C. elegans
tctgcactctctt

SEQ ID NO: 727976 - DNA, 13 bp, C. elegans
tctgcactttttt

SEQ ID NO: 727977 - DNA, 13 bp, C. elegans
tctgcatttattt

SEQ ID NO: 727978 - DNA, 13 bp, C. elegans
tctgcattttctc

SEQ ID NO: 727979 - DNA, 13 bp, C. elegans
tctgcatttttag

SEQ ID NO: 727980 - DNA, 13 bp, C. elegans
tctgcatttttca

SEQ ID NO: 727981 - DNA, 13 bp, C. elegans
tctgcattttttg

SEQ ID NO: 727982 - DNA, 13 bp, C. elegans
tctgccaagagat

SEQ ID NO: 727983 - DNA, 13 bp, C. elegans
tctgccaatttat

SEQ ID NO: 727984 - DNA, 13 bp, C. elegans
tctgccaattttc

SEQ ID NO: 727985 - DNA, 13 bp, C. elegans
tctgccacgtcat

SEQ ID NO: 727986 - DNA, 13 bp, C. elegans
tctgccatttcga

SEQ ID NO: 727987 - DNA, 13 bp, C. elegans
tctgccatttttc

SEQ ID NO: 727988 - DNA, 13 bp, C. elegans
tctgcgaaaaaaa

SEQ ID NO: 727989 - DNA, 13 bp, C. elegans
tctgcgaaatttt

SEQ ID NO: 727990 - DNA, 16 bp, C. elegans
tctgcgactctcaagc

SEQ ID NO: 727991 - DNA, 14 bp, C. elegans
tctgcgtctcaact

SEQ ID NO: 727992 - DNA, 13 bp, C. elegans
tctgcgtctctat

SEQ ID NO: 727993 - DNA, 13 bp, C. elegans
tctgcgtctctcc

SEQ ID NO: 727994 - DNA, 13 bp, C. elegans
tctgcgtctctcg

SEQ ID NO: 727995 - DNA, 13 bp, C. elegans
tctgcgtctcttc

SEQ ID NO: 727996 - DNA, 13 bp, C. elegans
tctgcgtcttttc

SEQ ID NO: 727997 - DNA, 13 bp, C. elegans
tctgcgtttctca

SEQ ID NO: 727998 - DNA, 13 bp, C. elegans
tctgctaataatt

SEQ ID NO: 727999 - DNA, 13 bp, C. elegans
tctgctgaaaaat

SEQ ID NO: 728000 - DNA, 13 bp, C. elegans
tctgctgctgctg

SEQ ID NO: 728001 - DNA, 13 bp, C. elegans
tctgcttctctgc

SEQ ID NO: 728002 - DNA, 13 bp, C. elegans
tctgcttgaactt

SEQ ID NO: 728003 - DNA, 13 bp, C. elegans
tctgcttttttaa

SEQ ID NO: 728004 - DNA, 13 bp, C. elegans
tctggaaaaatat

SEQ ID NO: 728005 - DNA, 13 bp, C. elegans
tctggaaaactag

SEQ ID NO: 728006 - DNA, 13 bp, C. elegans
tctggaaaattaa

SEQ ID NO: 728007 - DNA, 13 bp, C. elegans
tctggaaaattct

SEQ ID NO: 728008 - DNA, 13 bp, C. elegans
tctggaaaattga

SEQ ID NO: 728009 - DNA, 13 bp, C. elegans
tctggaaaattgg

SEQ ID NO: 728010 - DNA, 13 bp, C. elegans
tctggaaagtcag

SEQ ID NO: 728011 - DNA, 13 bp, C. elegans
tctggaaatgttt

SEQ ID NO: 728012 - DNA, 13 bp, C. elegans
tctggaaattatt

SEQ ID NO: 728013 - DNA, 13 bp, C. elegans
tctggaaattctg

SEQ ID NO: 728014 - DNA, 13 bp, C. elegans
tctggaaatttaa

SEQ ID NO: 728015 - DNA, 13 bp, C. elegans
tctggaacattcc

SEQ ID NO: 728016 - DNA, 13 bp, C. elegans
tctggaacattct

SEQ ID NO: 728017 - DNA, 13 bp, C. elegans
tctggaaccttct

SEQ ID NO: 728018 - DNA, 13 bp, C. elegans
tctggaagtttct

SEQ ID NO: 728019 - DNA, 13 bp, C. elegans
tctggaataaaaa

SEQ ID NO: 728020 - DNA, 13 bp, C. elegans
tctggaataattt

SEQ ID NO: 728021 - DNA, 13 bp, C. elegans
tctggaattattt

SEQ ID NO: 728022 - DNA, 13 bp, C. elegans
tctggaatttatc

SEQ ID NO: 728023 - DNA, 13 bp, C. elegans
tctggaattttat

SEQ ID NO: 728024 - DNA, 13 bp, C. elegans
tctggaatttttt

SEQ ID NO: 728025 - DNA, 13 bp, C. elegans
tctggagcttctg

SEQ ID NO: 728026 - DNA, 13 bp, C. elegans
tctggatatttta

SEQ ID NO: 728027 - DNA, 13 bp, C. elegans
tctggattactgt

SEQ ID NO: 728028 - DNA, 13 bp, C. elegans
tctggattttctt

SEQ ID NO: 728029 - DNA, 13 bp, C. elegans
tctggatttttgg

SEQ ID NO: 728030 - DNA, 13 bp, C. elegans
tctggcaatttgt

SEQ ID NO: 728031 - DNA, 14 bp, C. elegans
tctggcttcaaact

SEQ ID NO: 728032 - DNA, 13 bp, C. elegans
tctggcttcaccg

SEQ ID NO: 728033 - DNA, 19 bp, C. elegans
tctggcttccctcataaat

SEQ ID NO: 728034 - DNA, 13 bp, C. elegans
tctgggaaaaaac

SEQ ID NO: 728035 - DNA, 13 bp, C. elegans
tctgggattcagg

SEQ ID NO: 728036 - DNA, 13 bp, C. elegans
tctggtcttcctc

SEQ ID NO: 728037 - DNA, 13 bp, C. elegans
tctggtttctgaa

SEQ ID NO: 728038 - DNA, 13 bp, C. elegans
tctgtaaaaaatc

SEQ ID NO: 728039 - DNA, 13 bp, C. elegans
tctgtaaaacaaa

SEQ ID NO: 728040 - DNA, 13 bp, C. elegans
tctgtaaataatt

SEQ ID NO: 728041 - DNA, 13 bp, C. elegans
tctgtaaatattt

SEQ ID NO: 728042 - DNA, 13 bp, C. elegans
tctgtaaattttt

SEQ ID NO: 728043 - DNA, 13 bp, C. elegans
tctgtaatttaaa

SEQ ID NO: 728044 - DNA, 13 bp, C. elegans
tctgtacaatttt

SEQ ID NO: 728045 - DNA, 13 bp, C. elegans
tctgtacattttt

SEQ ID NO: 728046 - DNA, 13 bp, C. elegans
tctgtagaatttt

SEQ ID NO: 728047 - DNA, 13 bp, C. elegans
tctgtatgcttta

SEQ ID NO: 728048 - DNA, 13 bp, C. elegans
tctgtatttttga

SEQ ID NO: 728049 - DNA, 13 bp, C. elegans
tctgtcactctct

SEQ ID NO: 728050 - DNA, 13 bp, C. elegans
tctgtcatttttc

SEQ ID NO: 728051 - DNA, 13 bp, C. elegans
tctgtcgaagaaa

SEQ ID NO: 728052 - DNA, 13 bp, C. elegans
tctgtctgcgtct

SEQ ID NO: 728053 - DNA, 21 bp, C. elegans
tctgtctgtgtacaagatata

SEQ ID NO: 728054 - DNA, 13 bp, C. elegans
tctgtgaaaaaat

SEQ ID NO: 728055 - DNA, 13 bp, C. elegans
tctgtgaaaaatg

SEQ ID NO: 728056 - DNA, 13 bp, C. elegans
tctgtgaaaataa

SEQ ID NO: 728057 - DNA, 13 bp, C. elegans
tctgtgaaaatta

SEQ ID NO: 728058 - DNA, 13 bp, C. elegans
tctgtgaatattt

SEQ ID NO: 728059 - DNA, 13 bp, C. elegans
tctgtgaattttc

SEQ ID NO: 728060 - DNA, 13 bp, C. elegans
tctgtgaattttg

SEQ ID NO: 728061 - DNA, 13 bp, C. elegans
tctgtgacgtcat

SEQ ID NO: 728062 - DNA, 13 bp, C. elegans
tctgtgcaaacac

SEQ ID NO: 728063 - DNA, 13 bp, C. elegans
tctgtggaatttt

SEQ ID NO: 728064 - DNA, 13 bp, C. elegans
tctgtggatattt

SEQ ID NO: 728065 - DNA, 13 bp, C. elegans
tctgtgtctcttc

SEQ ID NO: 728066 - DNA, 13 bp, C. elegans
tctgtgttaaatt

SEQ ID NO: 728067 - DNA, 13 bp, C. elegans
tctgttcattttc

SEQ ID NO: 728068 - DNA, 13 bp, C. elegans
tctgttgatttta

SEQ ID NO: 728069 - DNA, 13 bp, C. elegans
tctgttgttgatc

SEQ ID NO: 728070 - DNA, 13 bp, C. elegans
tctgttgttttca

SEQ ID NO: 728071 - DNA, 13 bp, C. elegans
tctgtttaaaaaa

SEQ ID NO: 728072 - DNA, 13 bp, C. elegans
tctgtttcaaaat

SEQ ID NO: 728073 - DNA, 13 bp, C. elegans
tctgtttcaaatt

SEQ ID NO: 728074 - DNA, 13 bp, C. elegans
tctgtttcaacat

SEQ ID NO: 728075 - DNA, 13 bp, C. elegans
tctgtttcaattt

SEQ ID NO: 728076 - DNA, 13 bp, C. elegans
tctgtttcatatt

SEQ ID NO: 728077 - DNA, 13 bp, C. elegans
tctgtttctctat

SEQ ID NO: 728078 - DNA, 13 bp, C. elegans
tctgtttgaaaaa

SEQ ID NO: 728079 - DNA, 13 bp, C. elegans
tctgttttgaaaa

SEQ ID NO: 728080 - DNA, 13 bp, C. elegans
tctgtttttaaat

SEQ ID NO: 728081 - DNA, 13 bp, C. elegans
tctgttttttaca

SEQ ID NO: 728082 - DNA, 13 bp, C. elegans
tcttaaaaattag

SEQ ID NO: 728083 - DNA, 13 bp, C. elegans
tcttaaaatatca

SEQ ID NO: 728084 - DNA, 13 bp, C. elegans
tcttaaaatcaca

SEQ ID NO: 728085 - DNA, 13 bp, C. elegans
tcttaaatttcgg

SEQ ID NO: 728086 - DNA, 13 bp, C. elegans
tcttaaatttgtt

SEQ ID NO: 728087 - DNA, 13 bp, C. elegans
tcttaaccatgca

SEQ ID NO: 728088 - DNA, 16 bp, C. elegans
tcttaaccatgcgaaa

SEQ ID NO: 728089 - DNA, 13 bp, C. elegans
tcttaatattttg

SEQ ID NO: 728090 - DNA, 13 bp, C. elegans
tcttaatttcaat

SEQ ID NO: 728091 - DNA, 13 bp, C. elegans
tcttacaaaaaat

SEQ ID NO: 728092 - DNA, 13 bp, C. elegans
tcttacaacaaaa

SEQ ID NO: 728093 - DNA, 13 bp, C. elegans
tcttacaattaat

SEQ ID NO: 728094 - DNA, 13 bp, C. elegans
tcttacaatttta

SEQ ID NO: 728095 - DNA, 13 bp, C. elegans
tcttactattaat

SEQ ID NO: 728096 - DNA, 13 bp, C. elegans
tcttagaaacttt

SEQ ID NO: 728097 - DNA, 13 bp, C. elegans
tcttagtttttca

SEQ ID NO: 728098 - DNA, 13 bp, C. elegans
tcttatcaaaaaa

SEQ ID NO: 728099 - DNA, 13 bp, C. elegans
tcttatcaaaaca

SEQ ID NO: 728100 - DNA, 13 bp, C. elegans
tcttatcaatatt

SEQ ID NO: 728101 - DNA, 13 bp, C. elegans
tcttatcaatcaa

SEQ ID NO: 728102 - DNA, 13 bp, C. elegans
tcttatcaattga

SEQ ID NO: 728103 - DNA, 13 bp, C. elegans
tcttatcagtaaa

SEQ ID NO: 728104 - DNA, 13 bp, C. elegans
tcttatcagtgat

SEQ ID NO: 728105 - DNA, 13 bp, C. elegans
tcttatcagtgtt

SEQ ID NO: 728106 - DNA, 13 bp, C. elegans
tcttatcagtttt

SEQ ID NO: 728107 - DNA, 13 bp, C. elegans
tcttatgaatttt

SEQ ID NO: 728108 - DNA, 13 bp, C. elegans
tcttattacacat

SEQ ID NO: 728109 - DNA, 13 bp, C. elegans
tcttattcaaaat

SEQ ID NO: 728110 - DNA, 13 bp, C. elegans
tcttatttcaaaa

SEQ ID NO: 728111 - DNA, 13 bp, C. elegans
tcttattttgaaa

SEQ ID NO: 728112 - DNA, 13 bp, C. elegans
tcttcaaaaaata

SEQ ID NO: 728113 - DNA, 13 bp, C. elegans
tcttcaaaaaatg

SEQ ID NO: 728114 - DNA, 13 bp, C. elegans
tcttcaaaaatgt

SEQ ID NO: 728115 - DNA, 13 bp, C. elegans
tcttcaaaaattc

SEQ ID NO: 728116 - DNA, 13 bp, C. elegans
tcttcaaaacccc

SEQ ID NO: 728117 - DNA, 13 bp, C. elegans
tcttcaaaacgtg

SEQ ID NO: 728118 - DNA, 13 bp, C. elegans
tcttcaaaacgtt

SEQ ID NO: 728119 - DNA, 13 bp, C. elegans
tcttcaaaagcac

SEQ ID NO: 728120 - DNA, 13 bp, C. elegans
tcttcaaaagtgc

SEQ ID NO: 728121 - DNA, 13 bp, C. elegans
tcttcaaaatcat

SEQ ID NO: 728122 - DNA, 13 bp, C. elegans
tcttcaaaatgac

SEQ ID NO: 728123 - DNA, 13 bp, C. elegans
tcttcaaactggc

SEQ ID NO: 728124 - DNA, 13 bp, C. elegans
tcttcaaatattt

SEQ ID NO: 728125 - DNA, 13 bp, C. elegans
tcttcaaatcctc

SEQ ID NO: 728126 - DNA, 13 bp, C. elegans
tcttcaaatgttc

SEQ ID NO: 728127 - DNA, 13 bp, C. elegans
tcttcaaatgttt

SEQ ID NO: 728128 - DNA, 13 bp, C. elegans
tcttcaaattcaa

SEQ ID NO: 728129 - DNA, 13 bp, C. elegans
tcttcaaattctc

SEQ ID NO: 728130 - DNA, 13 bp, C. elegans
tcttcaaattgat

SEQ ID NO: 728131 - DNA, 13 bp, C. elegans
tcttcaaatttca

SEQ ID NO: 728132 - DNA, 13 bp, C. elegans
tcttcaaatttct

SEQ ID NO: 728133 - DNA, 13 bp, C. elegans
tcttcaacaaaat

SEQ ID NO: 728134 - DNA, 13 bp, C. elegans
tcttcaacatttt

SEQ ID NO: 728135 - DNA, 13 bp, C. elegans
tcttcaactttca

SEQ ID NO: 728136 - DNA, 13 bp, C. elegans
tcttcaacttttc

SEQ ID NO: 728137 - DNA, 13 bp, C. elegans
tcttcaagtgaaa

SEQ ID NO: 728138 - DNA, 13 bp, C. elegans
tcttcaagttttg

SEQ ID NO: 728139 - DNA, 13 bp, C. elegans
tcttcaataaaat

SEQ ID NO: 728140 - DNA, 13 bp, C. elegans
tcttcaattaatt

SEQ ID NO: 728141 - DNA, 13 bp, C. elegans
tcttcaattcatt

SEQ ID NO: 728142 - DNA, 13 bp, C. elegans
tcttcaattcttc

SEQ ID NO: 728143 - DNA, 13 bp, C. elegans
tcttcaattttca

SEQ ID NO: 728144 - DNA, 13 bp, C. elegans
tcttcacaacttt

SEQ ID NO: 728145 - DNA, 13 bp, C. elegans
tcttcacattttc

SEQ ID NO: 728146 - DNA, 13 bp, C. elegans
tcttcagaaaaat

SEQ ID NO: 728147 - DNA, 13 bp, C. elegans
tcttcagaaaatg

SEQ ID NO: 728148 - DNA, 13 bp, C. elegans
tcttcagaaattc

SEQ ID NO: 728149 - DNA, 13 bp, C. elegans
tcttcagttttca

SEQ ID NO: 728150 - DNA, 13 bp, C. elegans
tcttcataaaaat

SEQ ID NO: 728151 - DNA, 13 bp, C. elegans
tcttcatactgct

SEQ ID NO: 728152 - DNA, 13 bp, C. elegans
tcttcatatccaa

SEQ ID NO: 728153 - DNA, 13 bp, C. elegans
tcttcatatctcg

SEQ ID NO: 728154 - DNA, 13 bp, C. elegans
tcttcatcaattt

SEQ ID NO: 728155 - DNA, 13 bp, C. elegans
tcttcatcatcat

SEQ ID NO: 728156 - DNA, 13 bp, C. elegans
tcttcatcttcac

SEQ ID NO: 728157 - DNA, 13 bp, C. elegans
tcttcatgatttt

SEQ ID NO: 728158 - DNA, 13 bp, C. elegans
tcttcattcaaaa

SEQ ID NO: 728159 - DNA, 13 bp, C. elegans
tcttcattcaaat

SEQ ID NO: 728160 - DNA, 13 bp, C. elegans
tcttcattttccg

SEQ ID NO: 728161 - DNA, 13 bp, C. elegans
tcttcatttttcg

SEQ ID NO: 728162 - DNA, 13 bp, C. elegans
tcttccaaaaaaa

SEQ ID NO: 728163 - DNA, 13 bp, C. elegans
tcttccaaaaatt

SEQ ID NO: 728164 - DNA, 13 bp, C. elegans
tcttccaaattat

SEQ ID NO: 728165 - DNA, 13 bp, C. elegans
tcttccaaatttt

SEQ ID NO: 728166 - DNA, 13 bp, C. elegans
tcttccaacaaaa

SEQ ID NO: 728167 - DNA, 13 bp, C. elegans
tcttccaataaat

SEQ ID NO: 728168 - DNA, 13 bp, C. elegans
tcttccaatttat

SEQ ID NO: 728169 - DNA, 13 bp, C. elegans
tcttccacatttt

SEQ ID NO: 728170 - DNA, 13 bp, C. elegans
tcttccagttttt

SEQ ID NO: 728171 - DNA, 13 bp, C. elegans
tcttccatttcaa

SEQ ID NO: 728172 - DNA, 13 bp, C. elegans
tcttccatttcac

SEQ ID NO: 728173 - DNA, 13 bp, C. elegans
tcttccattttca

SEQ ID NO: 728174 - DNA, 13 bp, C. elegans
tcttcccaatttt

SEQ ID NO: 728175 - DNA, 13 bp, C. elegans
tcttcccagtttt

SEQ ID NO: 728176 - DNA, 13 bp, C. elegans
tcttcctatatta

SEQ ID NO: 728177 - DNA, 13 bp, C. elegans
tcttcctccacca

SEQ ID NO: 728178 - DNA, 13 bp, C. elegans
tcttcctgatggt

SEQ ID NO: 728179 - DNA, 13 bp, C. elegans
tcttcgaaaaaaa

SEQ ID NO: 728180 - DNA, 13 bp, C. elegans
tcttcgaaaaatg

SEQ ID NO: 728181 - DNA, 13 bp, C. elegans
tcttcgaattttg

SEQ ID NO: 728182 - DNA, 13 bp, C. elegans
tcttcgaattttt

SEQ ID NO: 728183 - DNA, 13 bp, C. elegans
tcttcgacaaaaa

SEQ ID NO: 728184 - DNA, 13 bp, C. elegans
tcttcggtggatt

SEQ ID NO: 728185 - DNA, 14 bp, C. elegans
tcttcgtcaatatt

SEQ ID NO: 728186 - DNA, 13 bp, C. elegans
tcttcgtcgtctt

SEQ ID NO: 728187 - DNA, 13 bp, C. elegans
tcttctaaaaata

SEQ ID NO: 728188 - DNA, 13 bp, C. elegans
tcttctacaaaaa

SEQ ID NO: 728189 - DNA, 13 bp, C. elegans
tcttctagaaatt

SEQ ID NO: 728190 - DNA, 13 bp, C. elegans
tcttctagaactt

SEQ ID NO: 728191 - DNA, 13 bp, C. elegans
tcttctagaagaa

SEQ ID NO: 728192 - DNA, 17 bp, C. elegans
tcttctattaatatggc

SEQ ID NO: 728193 - DNA, 13 bp, C. elegans
tcttctcaaaaat

SEQ ID NO: 728194 - DNA, 13 bp, C. elegans
tcttctcaaaatg

SEQ ID NO: 728195 - DNA, 13 bp, C. elegans
tcttctcaacttt

SEQ ID NO: 728196 - DNA, 13 bp, C. elegans
tcttctcaataaa

SEQ ID NO: 728197 - DNA, 13 bp, C. elegans
tcttctcaataat

SEQ ID NO: 728198 - DNA, 13 bp, C. elegans
tcttctcaattat

SEQ ID NO: 728199 - DNA, 13 bp, C. elegans
tcttctcacaaaa

SEQ ID NO: 728200 - DNA, 13 bp, C. elegans
tcttctccaattt

SEQ ID NO: 728201 - DNA, 13 bp, C. elegans
tcttctcgaaatt

SEQ ID NO: 728202 - DNA, 13 bp, C. elegans
tcttctctgaaaa

SEQ ID NO: 728203 - DNA, 13 bp, C. elegans
tcttctctgcgtc

SEQ ID NO: 728204 - DNA, 13 bp, C. elegans
tcttctctgtatt

SEQ ID NO: 728205 - DNA, 13 bp, C. elegans
tcttctgaaaaaa

SEQ ID NO: 728206 - DNA, 13 bp, C. elegans
tcttctgaaaact

SEQ ID NO: 728207 - DNA, 13 bp, C. elegans
tcttctgaaaatc

SEQ ID NO: 728208 - DNA, 13 bp, C. elegans
tcttctgagtttt

SEQ ID NO: 728209 - DNA, 13 bp, C. elegans
tcttcttcatcat

SEQ ID NO: 728210 - DNA, 13 bp, C. elegans
tcttcttccaaat

SEQ ID NO: 728211 - DNA, 13 bp, C. elegans
tcttcttcccaaa

SEQ ID NO: 728212 - DNA, 13 bp, C. elegans
tcttcttccgcat

SEQ ID NO: 728213 - DNA, 13 bp, C. elegans
tcttcttcgtcgt

SEQ ID NO: 728214 - DNA, 13 bp, C. elegans
tcttcttctacat

SEQ ID NO: 728215 - DNA, 13 bp, C. elegans
tcttcttctcaat

SEQ ID NO: 728216 - DNA, 13 bp, C. elegans
tcttcttctccaa

SEQ ID NO: 728217 - DNA, 13 bp, C. elegans
tcttcttctgatt

SEQ ID NO: 728218 - DNA, 13 bp, C. elegans
tcttcttcttcag

SEQ ID NO: 728219 - DNA, 13 bp, C. elegans
tcttcttcttcga

SEQ ID NO: 728220 - DNA, 13 bp, C. elegans
tcttcttgagctt

SEQ ID NO: 728221 - DNA, 13 bp, C. elegans
tcttcttttcaaa

SEQ ID NO: 728222 - DNA, 13 bp, C. elegans
tcttcttttcaca

SEQ ID NO: 728223 - DNA, 13 bp, C. elegans
tcttcttttcgta

SEQ ID NO: 728224 - DNA, 13 bp, C. elegans
tcttcttttgaaa

SEQ ID NO: 728225 - DNA, 13 bp, C. elegans
tcttctttttcag

SEQ ID NO: 728226 - DNA, 13 bp, C. elegans
tcttctttttgaa

SEQ ID NO: 728227 - DNA, 13 bp, C. elegans
tcttgaaaaatct

SEQ ID NO: 728228 - DNA, 13 bp, C. elegans
tcttgaaaaattt

SEQ ID NO: 728229 - DNA, 13 bp, C. elegans
tcttgaaaagaaa

SEQ ID NO: 728230 - DNA, 13 bp, C. elegans
tcttgaaaattaa

SEQ ID NO: 728231 - DNA, 13 bp, C. elegans
tcttgaaaattga

SEQ ID NO: 728232 - DNA, 13 bp, C. elegans
tcttgaaacaatt

SEQ ID NO: 728233 - DNA, 13 bp, C. elegans
tcttgaaacagtg

SEQ ID NO: 728234 - DNA, 13 bp, C. elegans
tcttgaaacagtt

SEQ ID NO: 728235 - DNA, 13 bp, C. elegans
tcttgaaagtgaa

SEQ ID NO: 728236 - DNA, 13 bp, C. elegans
tcttgaaatgaaa

SEQ ID NO: 728237 - DNA, 13 bp, C. elegans
tcttgaacttttt

SEQ ID NO: 728238 - DNA, 13 bp, C. elegans
tcttgaagaaaaa

SEQ ID NO: 728239 - DNA, 13 bp, C. elegans
tcttgaagctttt

SEQ ID NO: 728240 - DNA, 13 bp, C. elegans
tcttgaataaaat

SEQ ID NO: 728241 - DNA, 13 bp, C. elegans
tcttgaatatttt

SEQ ID NO: 728242 - DNA, 13 bp, C. elegans
tcttgaattgaat

SEQ ID NO: 728243 - DNA, 13 bp, C. elegans
tcttgaattttaa

SEQ ID NO: 728244 - DNA, 13 bp, C. elegans
tcttgaattttct

SEQ ID NO: 728245 - DNA, 13 bp, C. elegans
tcttgaatttttc

SEQ ID NO: 728246 - DNA, 13 bp, C. elegans
tcttgacattttc

SEQ ID NO: 728247 - DNA, 13 bp, C. elegans
tcttgacgttttt

SEQ ID NO: 728248 - DNA, 13 bp, C. elegans
tcttgagaaaaac

SEQ ID NO: 728249 - DNA, 13 bp, C. elegans
tcttgagttactc

SEQ ID NO: 728250 - DNA, 13 bp, C. elegans
tcttgattccatt

SEQ ID NO: 728251 - DNA, 13 bp, C. elegans
tcttgattctcaa

SEQ ID NO: 728252 - DNA, 13 bp, C. elegans
tcttgatttcatt

SEQ ID NO: 728253 - DNA, 13 bp, C. elegans
tcttgattttcaa

SEQ ID NO: 728254 - DNA, 13 bp, C. elegans
tcttgatttttca

SEQ ID NO: 728255 - DNA, 13 bp, C. elegans
tcttgcaaatcaa

SEQ ID NO: 728256 - DNA, 13 bp, C. elegans
tcttgcaaatttc

SEQ ID NO: 728257 - DNA, 13 bp, C. elegans
tcttgcaattttc

SEQ ID NO: 728258 - DNA, 13 bp, C. elegans
tcttgcattcaag

SEQ ID NO: 728259 - DNA, 13 bp, C. elegans
tcttgcattttta

SEQ ID NO: 728260 - DNA, 13 bp, C. elegans
tcttgcatttttc

SEQ ID NO: 728261 - DNA, 13 bp, C. elegans
tcttgcccagaaa

SEQ ID NO: 728262 - DNA, 13 bp, C. elegans
tcttgcgattttt

SEQ ID NO: 728263 - DNA, 13 bp, C. elegans
tcttggaaaatat

SEQ ID NO: 728264 - DNA, 13 bp, C. elegans
tcttggcgagacc

SEQ ID NO: 728265 - DNA, 13 bp, C. elegans
tcttggtcaaaaa

SEQ ID NO: 728266 - DNA, 13 bp, C. elegans
tcttggtgaaaaa

SEQ ID NO: 728267 - DNA, 13 bp, C. elegans
tcttgtaaataaa

SEQ ID NO: 728268 - DNA, 13 bp, C. elegans
tcttgtaactttt

SEQ ID NO: 728269 - DNA, 13 bp, C. elegans
tcttgtagtttgt

SEQ ID NO: 728270 - DNA, 13 bp, C. elegans
tcttgtcagtttt

SEQ ID NO: 728271 - DNA, 13 bp, C. elegans
tcttgtgaaaatg

SEQ ID NO: 728272 - DNA, 13 bp, C. elegans
tcttgtgaaatta

SEQ ID NO: 728273 - DNA, 13 bp, C. elegans
tcttgtgactttt

SEQ ID NO: 728274 - DNA, 13 bp, C. elegans
tcttgttcaaatt

SEQ ID NO: 728275 - DNA, 13 bp, C. elegans
tcttgttcaattt

SEQ ID NO: 728276 - DNA, 13 bp, C. elegans
tcttgtttcaaat

SEQ ID NO: 728277 - DNA, 13 bp, C. elegans
tctttaaaaactt

SEQ ID NO: 728278 - DNA, 13 bp, C. elegans
tctttaaaaagta

SEQ ID NO: 728279 - DNA, 13 bp, C. elegans
tctttaaaaattc

SEQ ID NO: 728280 - DNA, 13 bp, C. elegans
tctttaaaagttt

SEQ ID NO: 728281 - DNA, 13 bp, C. elegans
tctttaaaatttg

SEQ ID NO: 728282 - DNA, 13 bp, C. elegans
tctttaaactctc

SEQ ID NO: 728283 - DNA, 13 bp, C. elegans
tctttaaagaatt

SEQ ID NO: 728284 - DNA, 13 bp, C. elegans
tctttaaagattt

SEQ ID NO: 728285 - DNA, 13 bp, C. elegans
tctttaaaggagc

SEQ ID NO: 728286 - DNA, 13 bp, C. elegans
tctttaaatttca

SEQ ID NO: 728287 - DNA, 13 bp, C. elegans
tctttaattgatc

SEQ ID NO: 728288 - DNA, 13 bp, C. elegans
tctttaatttgaa

SEQ ID NO: 728289 - DNA, 13 bp, C. elegans
tctttacaacaat

SEQ ID NO: 728290 - DNA, 13 bp, C. elegans
tctttatgaattt

SEQ ID NO: 728291 - DNA, 13 bp, C. elegans
tctttattgaaaa

SEQ ID NO: 728292 - DNA, 13 bp, C. elegans
tctttatttgaat

SEQ ID NO: 728293 - DNA, 13 bp, C. elegans
tctttcaaaaatc

SEQ ID NO: 728294 - DNA, 13 bp, C. elegans
tctttcaaaaatg

SEQ ID NO: 728295 - DNA, 13 bp, C. elegans
tctttcaaaagtt

SEQ ID NO: 728296 - DNA, 13 bp, C. elegans
tctttcaaaccaa

SEQ ID NO: 728297 - DNA, 13 bp, C. elegans
tctttcaaataat

SEQ ID NO: 728298 - DNA, 13 bp, C. elegans
tctttcaaatgaa

SEQ ID NO: 728299 - DNA, 13 bp, C. elegans
tctttcaaatttg

SEQ ID NO: 728300 - DNA, 13 bp, C. elegans
tctttcagaaact

SEQ ID NO: 728301 - DNA, 13 bp, C. elegans
tctttcagaatat

SEQ ID NO: 728302 - DNA, 13 bp, C. elegans
tctttccaacttt

SEQ ID NO: 728303 - DNA, 13 bp, C. elegans
tctttcccaaaaa

SEQ ID NO: 728304 - DNA, 13 bp, C. elegans
tctttcccaattt

SEQ ID NO: 728305 - DNA, 13 bp, C. elegans
tctttcgatattt

SEQ ID NO: 728306 - DNA, 13 bp, C. elegans
tctttctcgattt

SEQ ID NO: 728307 - DNA, 13 bp, C. elegans
tctttctctcaca

SEQ ID NO: 728308 - DNA, 13 bp, C. elegans
tctttctgaaatt

SEQ ID NO: 728309 - DNA, 13 bp, C. elegans
tctttctgaatat

SEQ ID NO: 728310 - DNA, 13 bp, C. elegans
tctttctgatgaa

SEQ ID NO: 728311 - DNA, 13 bp, C. elegans
tctttctgcaaaa

SEQ ID NO: 728312 - DNA, 13 bp, C. elegans
tctttctgtaaat

SEQ ID NO: 728313 - DNA, 13 bp, C. elegans
tctttgaaaaatg

SEQ ID NO: 728314 - DNA, 13 bp, C. elegans
tctttgaaaacaa

SEQ ID NO: 728315 - DNA, 13 bp, C. elegans
tctttgaaacagt

SEQ ID NO: 728316 - DNA, 13 bp, C. elegans
tctttgaaatttt

SEQ ID NO: 728317 - DNA, 13 bp, C. elegans
tctttgaagcttc

SEQ ID NO: 728318 - DNA, 13 bp, C. elegans
tctttgaataatt

SEQ ID NO: 728319 - DNA, 13 bp, C. elegans
tctttgaatgact

SEQ ID NO: 728320 - DNA, 13 bp, C. elegans
tctttgaattttc

SEQ ID NO: 728321 - DNA, 13 bp, C. elegans
tctttgacaaaaa

SEQ ID NO: 728322 - DNA, 13 bp, C. elegans
tctttgacatttt

SEQ ID NO: 728323 - DNA, 13 bp, C. elegans
tctttgataattt

SEQ ID NO: 728324 - DNA, 13 bp, C. elegans
tctttgattgggc

SEQ ID NO: 728325 - DNA, 13 bp, C. elegans
tctttgcaaaaaa

SEQ ID NO: 728326 - DNA, 13 bp, C. elegans
tctttgcaaaatt

SEQ ID NO: 728327 - DNA, 13 bp, C. elegans
tctttgccatttt

SEQ ID NO: 728328 - DNA, 13 bp, C. elegans
tctttggaaaaaa

SEQ ID NO: 728329 - DNA, 13 bp, C. elegans
tctttggctacaa

SEQ ID NO: 728330 - DNA, 13 bp, C. elegans
tctttgggaaaaa

SEQ ID NO: 728331 - DNA, 13 bp, C. elegans
tctttgtagatca

SEQ ID NO: 728332 - DNA, 13 bp, C. elegans
tctttgtagtctt

SEQ ID NO: 728333 - DNA, 13 bp, C. elegans
tctttgttggaaa

SEQ ID NO: 728334 - DNA, 13 bp, C. elegans
tcttttatcaaaa

SEQ ID NO: 728335 - DNA, 13 bp, C. elegans
tcttttatcgaaa

SEQ ID NO: 728336 - DNA, 13 bp, C. elegans
tcttttcaaaaaa

SEQ ID NO: 728337 - DNA, 13 bp, C. elegans
tcttttcaaatta

SEQ ID NO: 728338 - DNA, 13 bp, C. elegans
tcttttcatcaaa

SEQ ID NO: 728339 - DNA, 13 bp, C. elegans
tcttttctattga

SEQ ID NO: 728340 - DNA, 13 bp, C. elegans
tcttttctcaaat

SEQ ID NO: 728341 - DNA, 13 bp, C. elegans
tcttttctctcaa

SEQ ID NO: 728342 - DNA, 13 bp, C. elegans
tcttttctctgaa

SEQ ID NO: 728343 - DNA, 13 bp, C. elegans
tcttttctgaatt

SEQ ID NO: 728344 - DNA, 13 bp, C. elegans
tcttttgaaaatt

SEQ ID NO: 728345 - DNA, 13 bp, C. elegans
tctttttccagtt

SEQ ID NO: 728346 - DNA, 13 bp, C. elegans
tctttttcggaaa

SEQ ID NO: 728347 - DNA, 13 bp, C. elegans
tctttttcgtgaa

SEQ ID NO: 728348 - DNA, 13 bp, C. elegans
tctttttctcaaa

SEQ ID NO: 728349 - DNA, 13 bp, C. elegans
tctttttctgaat

SEQ ID NO: 728350 - DNA, 14 bp, C. elegans
tctttttgaaaaat

SEQ ID NO: 728351 - DNA, 13 bp, C. elegans
tctttttgactac

SEQ ID NO: 728352 - DNA, 13 bp, C. elegans
tctttttgcaact

SEQ ID NO: 728353 - DNA, 13 bp, C. elegans
tctttttgctcaa

SEQ ID NO: 728354 - DNA, 13 bp, C. elegans
tcttttttcaaga

SEQ ID NO: 728355 - DNA, 14 bp, C. elegans
tcttttttcggaaa

SEQ ID NO: 728356 - DNA, 13 bp, C. elegans
tcttttttctgaa

SEQ ID NO: 728357 - DNA, 13 bp, C. elegans
tcttttttctgac

SEQ ID NO: 728358 - DNA, 13 bp, C. elegans
tcttttttgaaac

SEQ ID NO: 728359 - DNA, 13 bp, C. elegans
tcttttttgaaat

SEQ ID NO: 728360 - DNA, 13 bp, C. elegans
tcttttttgtcaa

SEQ ID NO: 728361 - DNA, 13 bp, C. elegans
tctttttttcaag

SEQ ID NO: 728362 - DNA, 13 bp, C. elegans
tctttttttgaaa

SEQ ID NO: 728363 - DNA, 13 bp, C. elegans
tgaaaaaaatcga

SEQ ID NO: 728364 - DNA, 13 bp, C. elegans
tgaaaaaacagat

SEQ ID NO: 728365 - DNA, 13 bp, C. elegans
tgaaaaaacttca

SEQ ID NO: 728366 - DNA, 13 bp, C. elegans
tgaaaaaactttt

SEQ ID NO: 728367 - DNA, 13 bp, C. elegans
tgaaaaaagattt

SEQ ID NO: 728368 - DNA, 13 bp, C. elegans
tgaaaaaagcgaa

SEQ ID NO: 728369 - DNA, 13 bp, C. elegans
tgaaaaaaggatt

SEQ ID NO: 728370 - DNA, 13 bp, C. elegans
tgaaaaaaggcat

SEQ ID NO: 728371 - DNA, 13 bp, C. elegans
tgaaaaaagtatt

SEQ ID NO: 728372 - DNA, 13 bp, C. elegans
tgaaaaaagtgat

SEQ ID NO: 728373 - DNA, 13 bp, C. elegans
tgaaaaaagttgg

SEQ ID NO: 728374 - DNA, 13 bp, C. elegans
tgaaaaaagtttt

SEQ ID NO: 728375 - DNA, 13 bp, C. elegans
tgaaaaaataatc

SEQ ID NO: 728376 - DNA, 13 bp, C. elegans
tgaaaaaatcaga

SEQ ID NO: 728377 - DNA, 13 bp, C. elegans
tgaaaaaatcagt

SEQ ID NO: 728378 - DNA, 13 bp, C. elegans
tgaaaaaatcctt

SEQ ID NO: 728379 - DNA, 14 bp, C. elegans
tgaaaaaatcgatt

SEQ ID NO: 728380 - DNA, 13 bp, C. elegans
tgaaaaaatctga

SEQ ID NO: 728381 - DNA, 13 bp, C. elegans
tgaaaaaatgaca

SEQ ID NO: 728382 - DNA, 13 bp, C. elegans
tgaaaaaatgtga

SEQ ID NO: 728383 - DNA, 13 bp, C. elegans
tgaaaaaatgttg

SEQ ID NO: 728384 - DNA, 13 bp, C. elegans
tgaaaaaattcaa

SEQ ID NO: 728385 - DNA, 13 bp, C. elegans
tgaaaaaattcca

SEQ ID NO: 728386 - DNA, 13 bp, C. elegans
tgaaaaaattcga

SEQ ID NO: 728387 - DNA, 13 bp, C. elegans
tgaaaaaattggc

SEQ ID NO: 728388 - DNA, 13 bp, C. elegans
tgaaaaaatttga

SEQ ID NO: 728389 - DNA, 13 bp, C. elegans
tgaaaaacaagtt

SEQ ID NO: 728390 - DNA, 13 bp, C. elegans
tgaaaaacaattt

SEQ ID NO: 728391 - DNA, 13 bp, C. elegans
tgaaaaacagtgc

SEQ ID NO: 728392 - DNA, 13 bp, C. elegans
tgaaaaacatcga

SEQ ID NO: 728393 - DNA, 13 bp, C. elegans
tgaaaaaccaata

SEQ ID NO: 728394 - DNA, 13 bp, C. elegans
tgaaaaaccatat

SEQ ID NO: 728395 - DNA, 13 bp, C. elegans
tgaaaaacctaaa

SEQ ID NO: 728396 - DNA, 13 bp, C. elegans
tgaaaaacctttt

SEQ ID NO: 728397 - DNA, 13 bp, C. elegans
tgaaaaacgaaca

SEQ ID NO: 728398 - DNA, 13 bp, C. elegans
tgaaaaacgaaga

SEQ ID NO: 728399 - DNA, 13 bp, C. elegans
tgaaaaacggaga

SEQ ID NO: 728400 - DNA, 13 bp, C. elegans
tgaaaaactactt

SEQ ID NO: 728401 - DNA, 14 bp, C. elegans
tgaaaaactcaaat

SEQ ID NO: 728402 - DNA, 13 bp, C. elegans
tgaaaaactctct

SEQ ID NO: 728403 - DNA, 13 bp, C. elegans
tgaaaaactgaaa

SEQ ID NO: 728404 - DNA, 13 bp, C. elegans
tgaaaaactggtt

SEQ ID NO: 728405 - DNA, 13 bp, C. elegans
tgaaaaactgttg

SEQ ID NO: 728406 - DNA, 13 bp, C. elegans
tgaaaaacttatt

SEQ ID NO: 728407 - DNA, 13 bp, C. elegans
tgaaaaacttgaa

SEQ ID NO: 728408 - DNA, 13 bp, C. elegans
tgaaaaacttttc

SEQ ID NO: 728409 - DNA, 13 bp, C. elegans
tgaaaaagaacac

SEQ ID NO: 728410 - DNA, 13 bp, C. elegans
tgaaaaagagcaa

SEQ ID NO: 728411 - DNA, 13 bp, C. elegans
tgaaaaagagcat

SEQ ID NO: 728412 - DNA, 13 bp, C. elegans
tgaaaaagatgag

SEQ ID NO: 728413 - DNA, 13 bp, C. elegans
tgaaaaagattga

SEQ ID NO: 728414 - DNA, 13 bp, C. elegans
tgaaaaagccaaa

SEQ ID NO: 728415 - DNA, 13 bp, C. elegans
tgaaaaagggaat

SEQ ID NO: 728416 - DNA, 13 bp, C. elegans
tgaaaaagtaatg

SEQ ID NO: 728417 - DNA, 13 bp, C. elegans
tgaaaaagtattt

SEQ ID NO: 728418 - DNA, 13 bp, C. elegans
tgaaaaagtctca

SEQ ID NO: 728419 - DNA, 13 bp, C. elegans
tgaaaaagtgctc

SEQ ID NO: 728420 - DNA, 13 bp, C. elegans
tgaaaaagtggat

SEQ ID NO: 728421 - DNA, 13 bp, C. elegans
tgaaaaagtggca

SEQ ID NO: 728422 - DNA, 13 bp, C. elegans
tgaaaaagtggct

SEQ ID NO: 728423 - DNA, 13 bp, C. elegans
tgaaaaagtggtt

SEQ ID NO: 728424 - DNA, 13 bp, C. elegans
tgaaaaagtgttt

SEQ ID NO: 728425 - DNA, 13 bp, C. elegans
tgaaaaagttcaa

SEQ ID NO: 728426 - DNA, 13 bp, C. elegans
tgaaaaagttgaa

SEQ ID NO: 728427 - DNA, 13 bp, C. elegans
tgaaaaagttgtc

SEQ ID NO: 728428 - DNA, 13 bp, C. elegans
tgaaaaagtttaa

SEQ ID NO: 728429 - DNA, 13 bp, C. elegans
tgaaaaagtttcc

SEQ ID NO: 728430 - DNA, 13 bp, C. elegans
tgaaaaagttttg

SEQ ID NO: 728431 - DNA, 13 bp, C. elegans
tgaaaaataagtt

SEQ ID NO: 728432 - DNA, 13 bp, C. elegans
tgaaaaatactaa

SEQ ID NO: 728433 - DNA, 13 bp, C. elegans
tgaaaaatagttc

SEQ ID NO: 728434 - DNA, 13 bp, C. elegans
tgaaaaatatgga

SEQ ID NO: 728435 - DNA, 13 bp, C. elegans
tgaaaaatattga

SEQ ID NO: 728436 - DNA, 13 bp, C. elegans
tgaaaaatcaaat

SEQ ID NO: 728437 - DNA, 13 bp, C. elegans
tgaaaaatcaaga

SEQ ID NO: 728438 - DNA, 13 bp, C. elegans
tgaaaaatcaatt

SEQ ID NO: 728439 - DNA, 13 bp, C. elegans
tgaaaaatcagtt

SEQ ID NO: 728440 - DNA, 13 bp, C. elegans
tgaaaaatcatca

SEQ ID NO: 728441 - DNA, 13 bp, C. elegans
tgaaaaatccgat

SEQ ID NO: 728442 - DNA, 13 bp, C. elegans
tgaaaaatcgaat

SEQ ID NO: 728443 - DNA, 13 bp, C. elegans
tgaaaaatcgatt

SEQ ID NO: 728444 - DNA, 13 bp, C. elegans
tgaaaaatctcat

SEQ ID NO: 728445 - DNA, 13 bp, C. elegans
tgaaaaatctttt

SEQ ID NO: 728446 - DNA, 13 bp, C. elegans
tgaaaaatgaaac

SEQ ID NO: 728447 - DNA, 13 bp, C. elegans
tgaaaaatgaaca

SEQ ID NO: 728448 - DNA, 13 bp, C. elegans
tgaaaaatgaact

SEQ ID NO: 728449 - DNA, 13 bp, C. elegans
tgaaaaatgagac

SEQ ID NO: 728450 - DNA, 13 bp, C. elegans
tgaaaaatgattg

SEQ ID NO: 728451 - DNA, 13 bp, C. elegans
tgaaaaatgcaga

SEQ ID NO: 728452 - DNA, 13 bp, C. elegans
tgaaaaatgcata

SEQ ID NO: 728453 - DNA, 13 bp, C. elegans
tgaaaaatgccaa

SEQ ID NO: 728454 - DNA, 13 bp, C. elegans
tgaaaaatgctca

SEQ ID NO: 728455 - DNA, 13 bp, C. elegans
tgaaaaatggata

SEQ ID NO: 728456 - DNA, 13 bp, C. elegans
tgaaaaatggatt

SEQ ID NO: 728457 - DNA, 13 bp, C. elegans
tgaaaaatgggat

SEQ ID NO: 728458 - DNA, 13 bp, C. elegans
tgaaaaatgggtg

SEQ ID NO: 728459 - DNA, 13 bp, C. elegans
tgaaaaatgtaga

SEQ ID NO: 728460 - DNA, 13 bp, C. elegans
tgaaaaatgtatt

SEQ ID NO: 728461 - DNA, 13 bp, C. elegans
tgaaaaatgtgaa

SEQ ID NO: 728462 - DNA, 13 bp, C. elegans
tgaaaaatgtgat

SEQ ID NO: 728463 - DNA, 13 bp, C. elegans
tgaaaaatgttaa

SEQ ID NO: 728464 - DNA, 13 bp, C. elegans
tgaaaaatgttta

SEQ ID NO: 728465 - DNA, 13 bp, C. elegans
tgaaaaattagga

SEQ ID NO: 728466 - DNA, 13 bp, C. elegans
tgaaaaattcaaa

SEQ ID NO: 728467 - DNA, 13 bp, C. elegans
tgaaaaattcaag

SEQ ID NO: 728468 - DNA, 13 bp, C. elegans
tgaaaaattcatt

SEQ ID NO: 728469 - DNA, 13 bp, C. elegans
tgaaaaattccaa

SEQ ID NO: 728470 - DNA, 13 bp, C. elegans
tgaaaaattccga

SEQ ID NO: 728471 - DNA, 13 bp, C. elegans
tgaaaaattcctt

SEQ ID NO: 728472 - DNA, 13 bp, C. elegans
tgaaaaattcgat

SEQ ID NO: 728473 - DNA, 14 bp, C. elegans
tgaaaaattctgaa

SEQ ID NO: 728474 - DNA, 13 bp, C. elegans
tgaaaaattgaag

SEQ ID NO: 728475 - DNA, 13 bp, C. elegans
tgaaaaattggaa

SEQ ID NO: 728476 - DNA, 13 bp, C. elegans
tgaaaaattggtt

SEQ ID NO: 728477 - DNA, 13 bp, C. elegans
tgaaaaatttcaa

SEQ ID NO: 728478 - DNA, 13 bp, C. elegans
tgaaaaatttcgg

SEQ ID NO: 728479 - DNA, 13 bp, C. elegans
tgaaaaatttgag

SEQ ID NO: 728480 - DNA, 13 bp, C. elegans
tgaaaaatttgat

SEQ ID NO: 728481 - DNA, 13 bp, C. elegans
tgaaaaatttgga

SEQ ID NO: 728482 - DNA, 13 bp, C. elegans
tgaaaaatttgtg

SEQ ID NO: 728483 - DNA, 13 bp, C. elegans
tgaaaaattttgg

SEQ ID NO: 728484 - DNA, 13 bp, C. elegans
tgaaaacaaaatg

SEQ ID NO: 728485 - DNA, 13 bp, C. elegans
tgaaaacaaaatt

SEQ ID NO: 728486 - DNA, 13 bp, C. elegans
tgaaaacaaatat

SEQ ID NO: 728487 - DNA, 13 bp, C. elegans
tgaaaacaaattt

SEQ ID NO: 728488 - DNA, 13 bp, C. elegans
tgaaaacaacaca

SEQ ID NO: 728489 - DNA, 13 bp, C. elegans
tgaaaacaacttt

SEQ ID NO: 728490 - DNA, 13 bp, C. elegans
tgaaaacaagcaa

SEQ ID NO: 728491 - DNA, 13 bp, C. elegans
tgaaaacaagttt

SEQ ID NO: 728492 - DNA, 13 bp, C. elegans
tgaaaacaattat

SEQ ID NO: 728493 - DNA, 13 bp, C. elegans
tgaaaacaattca

SEQ ID NO: 728494 - DNA, 13 bp, C. elegans
tgaaaacaatttg

SEQ ID NO: 728495 - DNA, 13 bp, C. elegans
tgaaaacacattt

SEQ ID NO: 728496 - DNA, 13 bp, C. elegans
tgaaaacagtaaa

SEQ ID NO: 728497 - DNA, 13 bp, C. elegans
tgaaaacatagtt

SEQ ID NO: 728498 - DNA, 13 bp, C. elegans
tgaaaacatcaaa

SEQ ID NO: 728499 - DNA, 13 bp, C. elegans
tgaaaacatcaat

SEQ ID NO: 728500 - DNA, 13 bp, C. elegans
tgaaaacatcttt

SEQ ID NO: 728501 - DNA, 13 bp, C. elegans
tgaaaacattaaa

SEQ ID NO: 728502 - DNA, 13 bp, C. elegans
tgaaaacattata

SEQ ID NO: 728503 - DNA, 13 bp, C. elegans
tgaaaacattatt

SEQ ID NO: 728504 - DNA, 13 bp, C. elegans
tgaaaacattcta

SEQ ID NO: 728505 - DNA, 13 bp, C. elegans
tgaaaacattgaa

SEQ ID NO: 728506 - DNA, 13 bp, C. elegans
tgaaaaccaataa

SEQ ID NO: 728507 - DNA, 13 bp, C. elegans
tgaaaaccagtgc

SEQ ID NO: 728508 - DNA, 13 bp, C. elegans
tgaaaacccaaaa

SEQ ID NO: 728509 - DNA, 13 bp, C. elegans
tgaaaacccaaat

SEQ ID NO: 728510 - DNA, 13 bp, C. elegans
tgaaaacctgaaa

SEQ ID NO: 728511 - DNA, 13 bp, C. elegans
tgaaaacgaacaa

SEQ ID NO: 728512 - DNA, 13 bp, C. elegans
tgaaaacgagaaa

SEQ ID NO: 728513 - DNA, 13 bp, C. elegans
tgaaaacgagaat

SEQ ID NO: 728514 - DNA, 13 bp, C. elegans
tgaaaacgataaa

SEQ ID NO: 728515 - DNA, 13 bp, C. elegans
tgaaaacgctcaa

SEQ ID NO: 728516 - DNA, 13 bp, C. elegans
tgaaaacggtaaa

SEQ ID NO: 728517 - DNA, 13 bp, C. elegans
tgaaaacgtttga

SEQ ID NO: 728518 - DNA, 13 bp, C. elegans
tgaaaactaaatt

SEQ ID NO: 728519 - DNA, 13 bp, C. elegans
tgaaaactacaaa

SEQ ID NO: 728520 - DNA, 13 bp, C. elegans
tgaaaactaccaa

SEQ ID NO: 728521 - DNA, 13 bp, C. elegans
tgaaaactatatt

SEQ ID NO: 728522 - DNA, 13 bp, C. elegans
tgaaaactatgaa

SEQ ID NO: 728523 - DNA, 13 bp, C. elegans
tgaaaactattga

SEQ ID NO: 728524 - DNA, 13 bp, C. elegans
tgaaaactcgatt

SEQ ID NO: 728525 - DNA, 13 bp, C. elegans
tgaaaactctgaa

SEQ ID NO: 728526 - DNA, 13 bp, C. elegans
tgaaaactctttt

SEQ ID NO: 728527 - DNA, 13 bp, C. elegans
tgaaaactgaaaa

SEQ ID NO: 728528 - DNA, 13 bp, C. elegans
tgaaaactgaaac

SEQ ID NO: 728529 - DNA, 13 bp, C. elegans
tgaaaactgacaa

SEQ ID NO: 728530 - DNA, 13 bp, C. elegans
tgaaaactgattt

SEQ ID NO: 728531 - DNA, 13 bp, C. elegans
tgaaaactgcaaa

SEQ ID NO: 728532 - DNA, 13 bp, C. elegans
tgaaaactggaaa

SEQ ID NO: 728533 - DNA, 13 bp, C. elegans
tgaaaactgttct

SEQ ID NO: 728534 - DNA, 13 bp, C. elegans
tgaaaacttaaaa

SEQ ID NO: 728535 - DNA, 13 bp, C. elegans
tgaaaacttacaa

SEQ ID NO: 728536 - DNA, 13 bp, C. elegans
tgaaaacttatat

SEQ ID NO: 728537 - DNA, 13 bp, C. elegans
tgaaaacttcaag

SEQ ID NO: 728538 - DNA, 13 bp, C. elegans
tgaaaacttccaa

SEQ ID NO: 728539 - DNA, 13 bp, C. elegans
tgaaaacttgaat

SEQ ID NO: 728540 - DNA, 13 bp, C. elegans
tgaaaactttaaa

SEQ ID NO: 728541 - DNA, 13 bp, C. elegans
tgaaaactttcat

SEQ ID NO: 728542 - DNA, 13 bp, C. elegans
tgaaaacttttca

SEQ ID NO: 728543 - DNA, 13 bp, C. elegans
tgaaaagaaaagc

SEQ ID NO: 728544 - DNA, 13 bp, C. elegans
tgaaaagaaattc

SEQ ID NO: 728545 - DNA, 13 bp, C. elegans
tgaaaagaaattt

SEQ ID NO: 728546 - DNA, 13 bp, C. elegans
tgaaaagaagcga

SEQ ID NO: 728547 - DNA, 13 bp, C. elegans
tgaaaagaagttt

SEQ ID NO: 728548 - DNA, 13 bp, C. elegans
tgaaaagaatttg

SEQ ID NO: 728549 - DNA, 13 bp, C. elegans
tgaaaagaatttt

SEQ ID NO: 728550 - DNA, 13 bp, C. elegans
tgaaaagagcaaa

SEQ ID NO: 728551 - DNA, 13 bp, C. elegans
tgaaaagatttca

SEQ ID NO: 728552 - DNA, 13 bp, C. elegans
tgaaaagcagaaa

SEQ ID NO: 728553 - DNA, 13 bp, C. elegans
tgaaaagctgaaa

SEQ ID NO: 728554 - DNA, 13 bp, C. elegans
tgaaaagcttgaa

SEQ ID NO: 728555 - DNA, 13 bp, C. elegans
tgaaaagctttaa

SEQ ID NO: 728556 - DNA, 13 bp, C. elegans
tgaaaaggatata

SEQ ID NO: 728557 - DNA, 13 bp, C. elegans
tgaaaagtacagt

SEQ ID NO: 728558 - DNA, 13 bp, C. elegans
tgaaaagtcaatt

SEQ ID NO: 728559 - DNA, 13 bp, C. elegans
tgaaaagtgaagt

SEQ ID NO: 728560 - DNA, 13 bp, C. elegans
tgaaaagtgatga

SEQ ID NO: 728561 - DNA, 13 bp, C. elegans
tgaaaagtgcaaa

SEQ ID NO: 728562 - DNA, 13 bp, C. elegans
tgaaaagtgtgtg

SEQ ID NO: 728563 - DNA, 13 bp, C. elegans
tgaaaagttatat

SEQ ID NO: 728564 - DNA, 13 bp, C. elegans
tgaaaagttgatt

SEQ ID NO: 728565 - DNA, 13 bp, C. elegans
tgaaaagttgcaa

SEQ ID NO: 728566 - DNA, 13 bp, C. elegans
tgaaaagttgcca

SEQ ID NO: 728567 - DNA, 13 bp, C. elegans
tgaaaagttgtac

SEQ ID NO: 728568 - DNA, 13 bp, C. elegans
tgaaaagtttgaa

SEQ ID NO: 728569 - DNA, 13 bp, C. elegans
tgaaaagttttag

SEQ ID NO: 728570 - DNA, 13 bp, C. elegans
tgaaaagttttat

SEQ ID NO: 728571 - DNA, 13 bp, C. elegans
tgaaaagttttca

SEQ ID NO: 728572 - DNA, 13 bp, C. elegans
tgaaaataaacat

SEQ ID NO: 728573 - DNA, 13 bp, C. elegans
tgaaaataagctt

SEQ ID NO: 728574 - DNA, 13 bp, C. elegans
tgaaaataagttt

SEQ ID NO: 728575 - DNA, 13 bp, C. elegans
tgaaaataatatg

SEQ ID NO: 728576 - DNA, 13 bp, C. elegans
tgaaaataatgat

SEQ ID NO: 728577 - DNA, 13 bp, C. elegans
tgaaaataatttg

SEQ ID NO: 728578 - DNA, 13 bp, C. elegans
tgaaaatacaaga

SEQ ID NO: 728579 - DNA, 13 bp, C. elegans
tgaaaataccaaa

SEQ ID NO: 728580 - DNA, 13 bp, C. elegans
tgaaaatacttca

SEQ ID NO: 728581 - DNA, 13 bp, C. elegans
tgaaaatagattt

SEQ ID NO: 728582 - DNA, 13 bp, C. elegans
tgaaaatagcatt

SEQ ID NO: 728583 - DNA, 13 bp, C. elegans
tgaaaatagcttt

SEQ ID NO: 728584 - DNA, 13 bp, C. elegans
tgaaaatatagtt

SEQ ID NO: 728585 - DNA, 13 bp, C. elegans
tgaaaatatattg

SEQ ID NO: 728586 - DNA, 13 bp, C. elegans
tgaaaatatcaaa

SEQ ID NO: 728587 - DNA, 13 bp, C. elegans
tgaaaatatgatt

SEQ ID NO: 728588 - DNA, 13 bp, C. elegans
tgaaaatatgtgt

SEQ ID NO: 728589 - DNA, 13 bp, C. elegans
tgaaaatatgttt

SEQ ID NO: 728590 - DNA, 13 bp, C. elegans
tgaaaatattcaa

SEQ ID NO: 728591 - DNA, 13 bp, C. elegans
tgaaaatattcag

SEQ ID NO: 728592 - DNA, 13 bp, C. elegans
tgaaaatattgct

SEQ ID NO: 728593 - DNA, 13 bp, C. elegans
tgaaaatatttca

SEQ ID NO: 728594 - DNA, 13 bp, C. elegans
tgaaaatattttc

SEQ ID NO: 728595 - DNA, 13 bp, C. elegans
tgaaaatcaaatt

SEQ ID NO: 728596 - DNA, 13 bp, C. elegans
tgaaaatcaagtt

SEQ ID NO: 728597 - DNA, 13 bp, C. elegans
tgaaaatcaatca

SEQ ID NO: 728598 - DNA, 13 bp, C. elegans
tgaaaatcaattt

SEQ ID NO: 728599 - DNA, 13 bp, C. elegans
tgaaaatcagaaa

SEQ ID NO: 728600 - DNA, 13 bp, C. elegans
tgaaaatcagaga

SEQ ID NO: 728601 - DNA, 13 bp, C. elegans
tgaaaatcagcga

SEQ ID NO: 728602 - DNA, 13 bp, C. elegans
tgaaaatcaggta

SEQ ID NO: 728603 - DNA, 13 bp, C. elegans
tgaaaatcatcat

SEQ ID NO: 728604 - DNA, 13 bp, C. elegans
tgaaaatcatcga

SEQ ID NO: 728605 - DNA, 13 bp, C. elegans
tgaaaatcatttt

SEQ ID NO: 728606 - DNA, 13 bp, C. elegans
tgaaaatccattt

SEQ ID NO: 728607 - DNA, 13 bp, C. elegans
tgaaaatccgaaa

SEQ ID NO: 728608 - DNA, 13 bp, C. elegans
tgaaaatccgaat

SEQ ID NO: 728609 - DNA, 13 bp, C. elegans
tgaaaatcctcaa

SEQ ID NO: 728610 - DNA, 13 bp, C. elegans
tgaaaatcgagaa

SEQ ID NO: 728611 - DNA, 13 bp, C. elegans
tgaaaatcgatat

SEQ ID NO: 728612 - DNA, 13 bp, C. elegans
tgaaaatcgatga

SEQ ID NO: 728613 - DNA, 13 bp, C. elegans
tgaaaatcgccga

SEQ ID NO: 728614 - DNA, 13 bp, C. elegans
tgaaaatcgcttt

SEQ ID NO: 728615 - DNA, 13 bp, C. elegans
tgaaaatcgggtt

SEQ ID NO: 728616 - DNA, 13 bp, C. elegans
tgaaaatcggtgg

SEQ ID NO: 728617 - DNA, 13 bp, C. elegans
tgaaaatcgtatt

SEQ ID NO: 728618 - DNA, 13 bp, C. elegans
tgaaaatcgtgat

SEQ ID NO: 728619 - DNA, 13 bp, C. elegans
tgaaaatctagaa

SEQ ID NO: 728620 - DNA, 13 bp, C. elegans
tgaaaatctcaaa

SEQ ID NO: 728621 - DNA, 13 bp, C. elegans
tgaaaatctcaga

SEQ ID NO: 728622 - DNA, 13 bp, C. elegans
tgaaaatctcatt

SEQ ID NO: 728623 - DNA, 13 bp, C. elegans
tgaaaatctccaa

SEQ ID NO: 728624 - DNA, 13 bp, C. elegans
tgaaaatctcgaa

SEQ ID NO: 728625 - DNA, 13 bp, C. elegans
tgaaaatctcttt

SEQ ID NO: 728626 - DNA, 13 bp, C. elegans
tgaaaatctggaa

SEQ ID NO: 728627 - DNA, 13 bp, C. elegans
tgaaaatcttcaa

SEQ ID NO: 728628 - DNA, 13 bp, C. elegans
tgaaaatcttgta

SEQ ID NO: 728629 - DNA, 13 bp, C. elegans
tgaaaatcttgtt

SEQ ID NO: 728630 - DNA, 13 bp, C. elegans
tgaaaatgaaact

SEQ ID NO: 728631 - DNA, 13 bp, C. elegans
tgaaaatgaatgt

SEQ ID NO: 728632 - DNA, 13 bp, C. elegans
tgaaaatgaattt

SEQ ID NO: 728633 - DNA, 13 bp, C. elegans
tgaaaatgacaaa

SEQ ID NO: 728634 - DNA, 13 bp, C. elegans
tgaaaatgacgaa

SEQ ID NO: 728635 - DNA, 13 bp, C. elegans
tgaaaatgagcaa

SEQ ID NO: 728636 - DNA, 13 bp, C. elegans
tgaaaatgagctt

SEQ ID NO: 728637 - DNA, 13 bp, C. elegans
tgaaaatgagtaa

SEQ ID NO: 728638 - DNA, 13 bp, C. elegans
tgaaaatgatatt

SEQ ID NO: 728639 - DNA, 13 bp, C. elegans
tgaaaatgatcat

SEQ ID NO: 728640 - DNA, 13 bp, C. elegans
tgaaaatgattaa

SEQ ID NO: 728641 - DNA, 13 bp, C. elegans
tgaaaatgattta

SEQ ID NO: 728642 - DNA, 13 bp, C. elegans
tgaaaatgatttt

SEQ ID NO: 728643 - DNA, 13 bp, C. elegans
tgaaaatgcaaat

SEQ ID NO: 728644 - DNA, 13 bp, C. elegans
tgaaaatgcaatt

SEQ ID NO: 728645 - DNA, 13 bp, C. elegans
tgaaaatgcgatt

SEQ ID NO: 728646 - DNA, 13 bp, C. elegans
tgaaaatgctctt

SEQ ID NO: 728647 - DNA, 13 bp, C. elegans
tgaaaatgctgaa

SEQ ID NO: 728648 - DNA, 13 bp, C. elegans
tgaaaatgctgga

SEQ ID NO: 728649 - DNA, 13 bp, C. elegans
tgaaaatgcttaa

SEQ ID NO: 728650 - DNA, 13 bp, C. elegans
tgaaaatgctttt

SEQ ID NO: 728651 - DNA, 13 bp, C. elegans
tgaaaatggacaa

SEQ ID NO: 728652 - DNA, 13 bp, C. elegans
tgaaaatggagtt

SEQ ID NO: 728653 - DNA, 13 bp, C. elegans
tgaaaatggatat

SEQ ID NO: 728654 - DNA, 13 bp, C. elegans
tgaaaatggatga

SEQ ID NO: 728655 - DNA, 13 bp, C. elegans
tgaaaatggcaaa

SEQ ID NO: 728656 - DNA, 13 bp, C. elegans
tgaaaatgggaaa

SEQ ID NO: 728657 - DNA, 13 bp, C. elegans
tgaaaatgggtaa

SEQ ID NO: 728658 - DNA, 13 bp, C. elegans
tgaaaatggtttt

SEQ ID NO: 728659 - DNA, 13 bp, C. elegans
tgaaaatgtacat

SEQ ID NO: 728660 - DNA, 13 bp, C. elegans
tgaaaatgtatcg

SEQ ID NO: 728661 - DNA, 13 bp, C. elegans
tgaaaatgtattg

SEQ ID NO: 728662 - DNA, 13 bp, C. elegans
tgaaaatgtcatt

SEQ ID NO: 728663 - DNA, 13 bp, C. elegans
tgaaaatgtcgaa

SEQ ID NO: 728664 - DNA, 13 bp, C. elegans
tgaaaatgtctca

SEQ ID NO: 728665 - DNA, 13 bp, C. elegans
tgaaaatgtcttt

SEQ ID NO: 728666 - DNA, 13 bp, C. elegans
tgaaaatgtgaat

SEQ ID NO: 728667 - DNA, 13 bp, C. elegans
tgaaaatgtgatt

SEQ ID NO: 728668 - DNA, 13 bp, C. elegans
tgaaaatgtgtgt

SEQ ID NO: 728669 - DNA, 13 bp, C. elegans
tgaaaatgtgttt

SEQ ID NO: 728670 - DNA, 13 bp, C. elegans
tgaaaatgttact

SEQ ID NO: 728671 - DNA, 13 bp, C. elegans
tgaaaatgttcaa

SEQ ID NO: 728672 - DNA, 13 bp, C. elegans
tgaaaatgttcag

SEQ ID NO: 728673 - DNA, 13 bp, C. elegans
tgaaaatgttctc

SEQ ID NO: 728674 - DNA, 13 bp, C. elegans
tgaaaatgttgaa

SEQ ID NO: 728675 - DNA, 13 bp, C. elegans
tgaaaatgttggg

SEQ ID NO: 728676 - DNA, 13 bp, C. elegans
tgaaaatgttgta

SEQ ID NO: 728677 - DNA, 13 bp, C. elegans
tgaaaatgtttaa

SEQ ID NO: 728678 - DNA, 13 bp, C. elegans
tgaaaatgtttag

SEQ ID NO: 728679 - DNA, 13 bp, C. elegans
tgaaaatgtttta

SEQ ID NO: 728680 - DNA, 13 bp, C. elegans
tgaaaattacagt

SEQ ID NO: 728681 - DNA, 13 bp, C. elegans
tgaaaattatgat

SEQ ID NO: 728682 - DNA, 13 bp, C. elegans
tgaaaattattga

SEQ ID NO: 728683 - DNA, 13 bp, C. elegans
tgaaaattcactt

SEQ ID NO: 728684 - DNA, 13 bp, C. elegans
tgaaaattccaga

SEQ ID NO: 728685 - DNA, 13 bp, C. elegans
tgaaaattccgaa

SEQ ID NO: 728686 - DNA, 13 bp, C. elegans
tgaaaattccttt

SEQ ID NO: 728687 - DNA, 13 bp, C. elegans
tgaaaattcgaga

SEQ ID NO: 728688 - DNA, 13 bp, C. elegans
tgaaaattctcaa

SEQ ID NO: 728689 - DNA, 13 bp, C. elegans
tgaaaattctgaa

SEQ ID NO: 728690 - DNA, 13 bp, C. elegans
tgaaaattctgtt

SEQ ID NO: 728691 - DNA, 13 bp, C. elegans
tgaaaattgaaat

SEQ ID NO: 728692 - DNA, 13 bp, C. elegans
tgaaaattgaagt

SEQ ID NO: 728693 - DNA, 13 bp, C. elegans
tgaaaattgacta

SEQ ID NO: 728694 - DNA, 13 bp, C. elegans
tgaaaattgactt

SEQ ID NO: 728695 - DNA, 13 bp, C. elegans
tgaaaattgagag

SEQ ID NO: 728696 - DNA, 13 bp, C. elegans
tgaaaattgagtt

SEQ ID NO: 728697 - DNA, 13 bp, C. elegans
tgaaaattgatta

SEQ ID NO: 728698 - DNA, 13 bp, C. elegans
tgaaaattgcaca

SEQ ID NO: 728699 - DNA, 13 bp, C. elegans
tgaaaattgccaa

SEQ ID NO: 728700 - DNA, 13 bp, C. elegans
tgaaaattgccga

SEQ ID NO: 728701 - DNA, 13 bp, C. elegans
tgaaaattgcgaa

SEQ ID NO: 728702 - DNA, 13 bp, C. elegans
tgaaaattgctct

SEQ ID NO: 728703 - DNA, 13 bp, C. elegans
tgaaaattgctga

SEQ ID NO: 728704 - DNA, 13 bp, C. elegans
tgaaaattggaaa

SEQ ID NO: 728705 - DNA, 13 bp, C. elegans
tgaaaattggaga

SEQ ID NO: 728706 - DNA, 13 bp, C. elegans
tgaaaattgggat

SEQ ID NO: 728707 - DNA, 13 bp, C. elegans
tgaaaattgtaca

SEQ ID NO: 728708 - DNA, 13 bp, C. elegans
tgaaaattgtatc

SEQ ID NO: 728709 - DNA, 13 bp, C. elegans
tgaaaattgtcaa

SEQ ID NO: 728710 - DNA, 13 bp, C. elegans
tgaaaattgtctg

SEQ ID NO: 728711 - DNA, 13 bp, C. elegans
tgaaaattgtgga

SEQ ID NO: 728712 - DNA, 13 bp, C. elegans
tgaaaattgtgtt

SEQ ID NO: 728713 - DNA, 13 bp, C. elegans
tgaaaattgttaa

SEQ ID NO: 728714 - DNA, 13 bp, C. elegans
tgaaaattgttat

SEQ ID NO: 728715 - DNA, 13 bp, C. elegans
tgaaaattgtttg

SEQ ID NO: 728716 - DNA, 13 bp, C. elegans
tgaaaatttaatg

SEQ ID NO: 728717 - DNA, 13 bp, C. elegans
tgaaaatttagaa

SEQ ID NO: 728718 - DNA, 13 bp, C. elegans
tgaaaatttagca

SEQ ID NO: 728719 - DNA, 13 bp, C. elegans
tgaaaatttatca

SEQ ID NO: 728720 - DNA, 13 bp, C. elegans
tgaaaatttccgg

SEQ ID NO: 728721 - DNA, 13 bp, C. elegans
tgaaaatttcgaa

SEQ ID NO: 728722 - DNA, 13 bp, C. elegans
tgaaaatttcgga

SEQ ID NO: 728723 - DNA, 13 bp, C. elegans
tgaaaatttgaat

SEQ ID NO: 728724 - DNA, 13 bp, C. elegans
tgaaaatttgaga

SEQ ID NO: 728725 - DNA, 13 bp, C. elegans
tgaaaatttgatt

SEQ ID NO: 728726 - DNA, 13 bp, C. elegans
tgaaaatttgcaa

SEQ ID NO: 728727 - DNA, 13 bp, C. elegans
tgaaaatttggaa

SEQ ID NO: 728728 - DNA, 13 bp, C. elegans
tgaaaattttaag

SEQ ID NO: 728729 - DNA, 13 bp, C. elegans
tgaaaattttact

SEQ ID NO: 728730 - DNA, 13 bp, C. elegans
tgaaaattttcaa

SEQ ID NO: 728731 - DNA, 13 bp, C. elegans
tgaaaattttcac

SEQ ID NO: 728732 - DNA, 13 bp, C. elegans
tgaaaattttcta

SEQ ID NO: 728733 - DNA, 14 bp, C. elegans
tgaaaattttgaat

SEQ ID NO: 728734 - DNA, 13 bp, C. elegans
tgaaaattttgat

SEQ ID NO: 728735 - DNA, 13 bp, C. elegans
tgaaaattttgtt

SEQ ID NO: 728736 - DNA, 13 bp, C. elegans
tgaaaatttttgg

SEQ ID NO: 728737 - DNA, 13 bp, C. elegans
tgaaacaaaagtt

SEQ ID NO: 728738 - DNA, 13 bp, C. elegans
tgaaacaaatagt

SEQ ID NO: 728739 - DNA, 13 bp, C. elegans
tgaaacaaatatt

SEQ ID NO: 728740 - DNA, 13 bp, C. elegans
tgaaacaaatcaa

SEQ ID NO: 728741 - DNA, 13 bp, C. elegans
tgaaacaacattt

SEQ ID NO: 728742 - DNA, 13 bp, C. elegans
tgaaacaactttt

SEQ ID NO: 728743 - DNA, 13 bp, C. elegans
tgaaacaagaaat

SEQ ID NO: 728744 - DNA, 13 bp, C. elegans
tgaaacaagttca

SEQ ID NO: 728745 - DNA, 13 bp, C. elegans
tgaaacaagtttt

SEQ ID NO: 728746 - DNA, 13 bp, C. elegans
tgaaacaattaat

SEQ ID NO: 728747 - DNA, 13 bp, C. elegans
tgaaacaatttca

SEQ ID NO: 728748 - DNA, 13 bp, C. elegans
tgaaacaattttt

SEQ ID NO: 728749 - DNA, 13 bp, C. elegans
tgaaacacaattt

SEQ ID NO: 728750 - DNA, 13 bp, C. elegans
tgaaacactattt

SEQ ID NO: 728751 - DNA, 13 bp, C. elegans
tgaaacactgaaa

SEQ ID NO: 728752 - DNA, 13 bp, C. elegans
tgaaacacttgaa

SEQ ID NO: 728753 - DNA, 13 bp, C. elegans
tgaaacagaaaat

SEQ ID NO: 728754 - DNA, 13 bp, C. elegans
tgaaacagaacaa

SEQ ID NO: 728755 - DNA, 13 bp, C. elegans
tgaaacagataat

SEQ ID NO: 728756 - DNA, 13 bp, C. elegans
tgaaacagcaaat

SEQ ID NO: 728757 - DNA, 13 bp, C. elegans
tgaaacaggaaaa

SEQ ID NO: 728758 - DNA, 13 bp, C. elegans
tgaaacaggaata

SEQ ID NO: 728759 - DNA, 13 bp, C. elegans
tgaaacaggggtg

SEQ ID NO: 728760 - DNA, 13 bp, C. elegans
tgaaacagtaaaa

SEQ ID NO: 728761 - DNA, 13 bp, C. elegans
tgaaacagtaaat

SEQ ID NO: 728762 - DNA, 13 bp, C. elegans
tgaaacagtcaaa

SEQ ID NO: 728763 - DNA, 13 bp, C. elegans
tgaaacagtcaat

SEQ ID NO: 728764 - DNA, 13 bp, C. elegans
tgaaacagtggaa

SEQ ID NO: 728765 - DNA, 13 bp, C. elegans
tgaaacagttgat

SEQ ID NO: 728766 - DNA, 13 bp, C. elegans
tgaaacagtttat

SEQ ID NO: 728767 - DNA, 13 bp, C. elegans
tgaaacagtttta

SEQ ID NO: 728768 - DNA, 13 bp, C. elegans
tgaaacatatata

SEQ ID NO: 728769 - DNA, 13 bp, C. elegans
tgaaacatattgg

SEQ ID NO: 728770 - DNA, 13 bp, C. elegans
tgaaacatatttc

SEQ ID NO: 728771 - DNA, 13 bp, C. elegans
tgaaacatatttt

SEQ ID NO: 728772 - DNA, 13 bp, C. elegans
tgaaacatcaaat

SEQ ID NO: 728773 - DNA, 13 bp, C. elegans
tgaaacatcaact

SEQ ID NO: 728774 - DNA, 13 bp, C. elegans
tgaaacatcaatt

SEQ ID NO: 728775 - DNA, 13 bp, C. elegans
tgaaacatgaaaa

SEQ ID NO: 728776 - DNA, 13 bp, C. elegans
tgaaacatgcaaa

SEQ ID NO: 728777 - DNA, 13 bp, C. elegans
tgaaacatgtaaa

SEQ ID NO: 728778 - DNA, 13 bp, C. elegans
tgaaacatgtgaa

SEQ ID NO: 728779 - DNA, 13 bp, C. elegans
tgaaacatgtgat

SEQ ID NO: 728780 - DNA, 13 bp, C. elegans
tgaaacatgtttc

SEQ ID NO: 728781 - DNA, 13 bp, C. elegans
tgaaacattgaat

SEQ ID NO: 728782 - DNA, 13 bp, C. elegans
tgaaacattgcaa

SEQ ID NO: 728783 - DNA, 13 bp, C. elegans
tgaaacattgttt

SEQ ID NO: 728784 - DNA, 13 bp, C. elegans
tgaaacatttatt

SEQ ID NO: 728785 - DNA, 13 bp, C. elegans
tgaaacatttgat

SEQ ID NO: 728786 - DNA, 13 bp, C. elegans
tgaaacatttgga

SEQ ID NO: 728787 - DNA, 13 bp, C. elegans
tgaaacatttttg

SEQ ID NO: 728788 - DNA, 13 bp, C. elegans
tgaaaccaaaaac

SEQ ID NO: 728789 - DNA, 13 bp, C. elegans
tgaaaccaaccga

SEQ ID NO: 728790 - DNA, 13 bp, C. elegans
tgaaaccagtttt

SEQ ID NO: 728791 - DNA, 13 bp, C. elegans
tgaaaccataatt

SEQ ID NO: 728792 - DNA, 13 bp, C. elegans
tgaaacccaattt

SEQ ID NO: 728793 - DNA, 13 bp, C. elegans
tgaaacccatttt

SEQ ID NO: 728794 - DNA, 13 bp, C. elegans
tgaaaccgaaaaa

SEQ ID NO: 728795 - DNA, 13 bp, C. elegans
tgaaaccggaaaa

SEQ ID NO: 728796 - DNA, 13 bp, C. elegans
tgaaacctgaaaa

SEQ ID NO: 728797 - DNA, 13 bp, C. elegans
tgaaacgaaaatt

SEQ ID NO: 728798 - DNA, 13 bp, C. elegans
tgaaacgaaacaa

SEQ ID NO: 728799 - DNA, 13 bp, C. elegans
tgaaacggaaaat

SEQ ID NO: 728800 - DNA, 13 bp, C. elegans
tgaaacggagaaa

SEQ ID NO: 728801 - DNA, 13 bp, C. elegans
tgaaacgtgaaaa

SEQ ID NO: 728802 - DNA, 13 bp, C. elegans
tgaaacgttttat

SEQ ID NO: 728803 - DNA, 13 bp, C. elegans
tgaaacgttttca

SEQ ID NO: 728804 - DNA, 13 bp, C. elegans
tgaaacgtttttg

SEQ ID NO: 728805 - DNA, 13 bp, C. elegans
tgaaactaaaatt

SEQ ID NO: 728806 - DNA, 13 bp, C. elegans
tgaaactaaatat

SEQ ID NO: 728807 - DNA, 13 bp, C. elegans
tgaaactaaatta

SEQ ID NO: 728808 - DNA, 13 bp, C. elegans
tgaaactaatttt

SEQ ID NO: 728809 - DNA, 13 bp, C. elegans
tgaaactacagta

SEQ ID NO: 728810 - DNA, 13 bp, C. elegans
tgaaactattaat

SEQ ID NO: 728811 - DNA, 13 bp, C. elegans
tgaaactattcat

SEQ ID NO: 728812 - DNA, 13 bp, C. elegans
tgaaactattgaa

SEQ ID NO: 728813 - DNA, 13 bp, C. elegans
tgaaactcaaaaa

SEQ ID NO: 728814 - DNA, 13 bp, C. elegans
tgaaactcattta

SEQ ID NO: 728815 - DNA, 13 bp, C. elegans
tgaaactcgaatt

SEQ ID NO: 728816 - DNA, 13 bp, C. elegans
tgaaactcgtttt

SEQ ID NO: 728817 - DNA, 13 bp, C. elegans
tgaaactctaaaa

SEQ ID NO: 728818 - DNA, 13 bp, C. elegans
tgaaactctgaaa

SEQ ID NO: 728819 - DNA, 13 bp, C. elegans
tgaaactgaaaaa

SEQ ID NO: 728820 - DNA, 13 bp, C. elegans
tgaaactgaaaat

SEQ ID NO: 728821 - DNA, 13 bp, C. elegans
tgaaactgaaact

SEQ ID NO: 728822 - DNA, 13 bp, C. elegans
tgaaactgaaatt

SEQ ID NO: 728823 - DNA, 13 bp, C. elegans
tgaaactgatttt

SEQ ID NO: 728824 - DNA, 13 bp, C. elegans
tgaaactgctcaa

SEQ ID NO: 728825 - DNA, 13 bp, C. elegans
tgaaactggtgct

SEQ ID NO: 728826 - DNA, 13 bp, C. elegans
tgaaactgtaaat

SEQ ID NO: 728827 - DNA, 13 bp, C. elegans
tgaaactgtattt

SEQ ID NO: 728828 - DNA, 13 bp, C. elegans
tgaaactgttaaa

SEQ ID NO: 728829 - DNA, 13 bp, C. elegans
tgaaactgttcaa

SEQ ID NO: 728830 - DNA, 13 bp, C. elegans
tgaaacttaaaaa

SEQ ID NO: 728831 - DNA, 13 bp, C. elegans
tgaaacttaaatt

SEQ ID NO: 728832 - DNA, 13 bp, C. elegans
tgaaacttatttt

SEQ ID NO: 728833 - DNA, 13 bp, C. elegans
tgaaacttcaatt

SEQ ID NO: 728834 - DNA, 13 bp, C. elegans
tgaaacttcacca

SEQ ID NO: 728835 - DNA, 13 bp, C. elegans
tgaaacttcagat

SEQ ID NO: 728836 - DNA, 13 bp, C. elegans
tgaaacttctaaa

SEQ ID NO: 728837 - DNA, 13 bp, C. elegans
tgaaacttcttaa

SEQ ID NO: 728838 - DNA, 13 bp, C. elegans
tgaaacttgaaaa

SEQ ID NO: 728839 - DNA, 13 bp, C. elegans
tgaaacttgggtt

SEQ ID NO: 728840 - DNA, 13 bp, C. elegans
tgaaacttgtaaa

SEQ ID NO: 728841 - DNA, 13 bp, C. elegans
tgaaactttcaaa

SEQ ID NO: 728842 - DNA, 13 bp, C. elegans
tgaaactttctga

SEQ ID NO: 728843 - DNA, 13 bp, C. elegans
tgaaactttgaag

SEQ ID NO: 728844 - DNA, 13 bp, C. elegans
tgaaacttttaat

SEQ ID NO: 728845 - DNA, 13 bp, C. elegans
tgaaacttttcga

SEQ ID NO: 728846 - DNA, 13 bp, C. elegans
tgaaacttttctt

SEQ ID NO: 728847 - DNA, 13 bp, C. elegans
tgaaacttttgta

SEQ ID NO: 728848 - DNA, 13 bp, C. elegans
tgaaagaacataa

SEQ ID NO: 728849 - DNA, 13 bp, C. elegans
tgaaagaagagac

SEQ ID NO: 728850 - DNA, 13 bp, C. elegans
tgaaagagcaaaa

SEQ ID NO: 728851 - DNA, 13 bp, C. elegans
tgaaagagcacaa

SEQ ID NO: 728852 - DNA, 13 bp, C. elegans
tgaaagagttttt

SEQ ID NO: 728853 - DNA, 13 bp, C. elegans
tgaaagatatcaa

SEQ ID NO: 728854 - DNA, 13 bp, C. elegans
tgaaagatcaaag

SEQ ID NO: 728855 - DNA, 13 bp, C. elegans
tgaaagatttcaa

SEQ ID NO: 728856 - DNA, 13 bp, C. elegans
tgaaagatttgtt

SEQ ID NO: 728857 - DNA, 13 bp, C. elegans
tgaaagcaaaatt

SEQ ID NO: 728858 - DNA, 13 bp, C. elegans
tgaaagcaaataa

SEQ ID NO: 728859 - DNA, 13 bp, C. elegans
tgaaagcatttta

SEQ ID NO: 728860 - DNA, 13 bp, C. elegans
tgaaagccgaaaa

SEQ ID NO: 728861 - DNA, 13 bp, C. elegans
tgaaagcctgaaa

SEQ ID NO: 728862 - DNA, 13 bp, C. elegans
tgaaagctgtcaa

SEQ ID NO: 728863 - DNA, 13 bp, C. elegans
tgaaagctttaaa

SEQ ID NO: 728864 - DNA, 13 bp, C. elegans
tgaaagctttgaa

SEQ ID NO: 728865 - DNA, 13 bp, C. elegans
tgaaagcttttga

SEQ ID NO: 728866 - DNA, 13 bp, C. elegans
tgaaagtaaattt

SEQ ID NO: 728867 - DNA, 13 bp, C. elegans
tgaaagtcaaaaa

SEQ ID NO: 728868 - DNA, 13 bp, C. elegans
tgaaagtcatttt

SEQ ID NO: 728869 - DNA, 13 bp, C. elegans
tgaaagtcgaaaa

SEQ ID NO: 728870 - DNA, 13 bp, C. elegans
tgaaagtgaaaat

SEQ ID NO: 728871 - DNA, 13 bp, C. elegans
tgaaagtgaaacc

SEQ ID NO: 728872 - DNA, 13 bp, C. elegans
tgaaagtggtcaa

SEQ ID NO: 728873 - DNA, 13 bp, C. elegans
tgaaagtgtgaaa

SEQ ID NO: 728874 - DNA, 13 bp, C. elegans
tgaaagttaattt

SEQ ID NO: 728875 - DNA, 13 bp, C. elegans
tgaaagttatatt

SEQ ID NO: 728876 - DNA, 13 bp, C. elegans
tgaaagttattca

SEQ ID NO: 728877 - DNA, 13 bp, C. elegans
tgaaagttcaaaa

SEQ ID NO: 728878 - DNA, 13 bp, C. elegans
tgaaagttcaagt

SEQ ID NO: 728879 - DNA, 13 bp, C. elegans
tgaaagttccaaa

SEQ ID NO: 728880 - DNA, 13 bp, C. elegans
tgaaagttctcaa

SEQ ID NO: 728881 - DNA, 13 bp, C. elegans
tgaaagttctgta

SEQ ID NO: 728882 - DNA, 13 bp, C. elegans
tgaaagttgaaag

SEQ ID NO: 728883 - DNA, 13 bp, C. elegans
tgaaagttgaaga

SEQ ID NO: 728884 - DNA, 13 bp, C. elegans
tgaaagttgaatt

SEQ ID NO: 728885 - DNA, 13 bp, C. elegans
tgaaagttgataa

SEQ ID NO: 728886 - DNA, 13 bp, C. elegans
tgaaagttgattt

SEQ ID NO: 728887 - DNA, 13 bp, C. elegans
tgaaagttgttca

SEQ ID NO: 728888 - DNA, 13 bp, C. elegans
tgaaagttgtttt

SEQ ID NO: 728889 - DNA, 13 bp, C. elegans
tgaaagtttaatt

SEQ ID NO: 728890 - DNA, 13 bp, C. elegans
tgaaagtttagtt

SEQ ID NO: 728891 - DNA, 13 bp, C. elegans
tgaaagtttcaaa

SEQ ID NO: 728892 - DNA, 13 bp, C. elegans
tgaaagtttccaa

SEQ ID NO: 728893 - DNA, 13 bp, C. elegans
tgaaagtttggaa

SEQ ID NO: 728894 - DNA, 13 bp, C. elegans
tgaaagttttaaa

SEQ ID NO: 728895 - DNA, 13 bp, C. elegans
tgaaagttttaca

SEQ ID NO: 728896 - DNA, 13 bp, C. elegans
tgaaagttttagt

SEQ ID NO: 728897 - DNA, 13 bp, C. elegans
tgaaagttttata

SEQ ID NO: 728898 - DNA, 13 bp, C. elegans
tgaaagttttcaa

SEQ ID NO: 728899 - DNA, 13 bp, C. elegans
tgaaagttttcat

SEQ ID NO: 728900 - DNA, 13 bp, C. elegans
tgaaagttttcga

SEQ ID NO: 728901 - DNA, 13 bp, C. elegans
tgaaagtttttga

SEQ ID NO: 728902 - DNA, 13 bp, C. elegans
tgaaagtttttgg

SEQ ID NO: 728903 - DNA, 13 bp, C. elegans
tgaaagtttttgt

SEQ ID NO: 728904 - DNA, 13 bp, C. elegans
tgaaataaaaacc

SEQ ID NO: 728905 - DNA, 13 bp, C. elegans
tgaaataaacatt

SEQ ID NO: 728906 - DNA, 13 bp, C. elegans
tgaaataacagaa

SEQ ID NO: 728907 - DNA, 13 bp, C. elegans
tgaaataactgaa

SEQ ID NO: 728908 - DNA, 13 bp, C. elegans
tgaaataagtttt

SEQ ID NO: 728909 - DNA, 13 bp, C. elegans
tgaaataataaca

SEQ ID NO: 728910 - DNA, 13 bp, C. elegans
tgaaataatcatt

SEQ ID NO: 728911 - DNA, 13 bp, C. elegans
tgaaataattcaa

SEQ ID NO: 728912 - DNA, 13 bp, C. elegans
tgaaatactacct

SEQ ID NO: 728913 - DNA, 13 bp, C. elegans
tgaaatacttttt

SEQ ID NO: 728914 - DNA, 13 bp, C. elegans
tgaaatagaacaa

SEQ ID NO: 728915 - DNA, 13 bp, C. elegans
tgaaatagatgtt

SEQ ID NO: 728916 - DNA, 13 bp, C. elegans
tgaaatagtattt

SEQ ID NO: 728917 - DNA, 13 bp, C. elegans
tgaaatagttgaa

SEQ ID NO: 728918 - DNA, 13 bp, C. elegans
tgaaatagttttt

SEQ ID NO: 728919 - DNA, 13 bp, C. elegans
tgaaatataattc

SEQ ID NO: 728920 - DNA, 13 bp, C. elegans
tgaaatatatcaa

SEQ ID NO: 728921 - DNA, 13 bp, C. elegans
tgaaatatatcat

SEQ ID NO: 728922 - DNA, 13 bp, C. elegans
tgaaatatcaaaa

SEQ ID NO: 728923 - DNA, 13 bp, C. elegans
tgaaatatgaaat

SEQ ID NO: 728924 - DNA, 13 bp, C. elegans
tgaaatatggaaa

SEQ ID NO: 728925 - DNA, 13 bp, C. elegans
tgaaatatgtaaa

SEQ ID NO: 728926 - DNA, 13 bp, C. elegans
tgaaatattgaac

SEQ ID NO: 728927 - DNA, 13 bp, C. elegans
tgaaatattgatg

SEQ ID NO: 728928 - DNA, 13 bp, C. elegans
tgaaatattgcat

SEQ ID NO: 728929 - DNA, 13 bp, C. elegans
tgaaatattgttt

SEQ ID NO: 728930 - DNA, 13 bp, C. elegans
tgaaatatttgga

SEQ ID NO: 728931 - DNA, 13 bp, C. elegans
tgaaatattttca

SEQ ID NO: 728932 - DNA, 13 bp, C. elegans
tgaaatcaaaaac

SEQ ID NO: 728933 - DNA, 13 bp, C. elegans
tgaaatcaaaaat

SEQ ID NO: 728934 - DNA, 13 bp, C. elegans
tgaaatcaaaaga

SEQ ID NO: 728935 - DNA, 13 bp, C. elegans
tgaaatcaaaatc

SEQ ID NO: 728936 - DNA, 13 bp, C. elegans
tgaaatcaaaatt

SEQ ID NO: 728937 - DNA, 13 bp, C. elegans
tgaaatcaaacaa

SEQ ID NO: 728938 - DNA, 13 bp, C. elegans
tgaaatcaaactt

SEQ ID NO: 728939 - DNA, 13 bp, C. elegans
tgaaatcaaagtt

SEQ ID NO: 728940 - DNA, 13 bp, C. elegans
tgaaatcaaatca

SEQ ID NO: 728941 - DNA, 13 bp, C. elegans
tgaaatcaaatga

SEQ ID NO: 728942 - DNA, 13 bp, C. elegans
tgaaatcaaattc

SEQ ID NO: 728943 - DNA, 13 bp, C. elegans
tgaaatcaatgaa

SEQ ID NO: 728944 - DNA, 13 bp, C. elegans
tgaaatcaattaa

SEQ ID NO: 728945 - DNA, 13 bp, C. elegans
tgaaatcaatttg

SEQ ID NO: 728946 - DNA, 13 bp, C. elegans
tgaaatcaatttt

SEQ ID NO: 728947 - DNA, 13 bp, C. elegans
tgaaatcagaatt

SEQ ID NO: 728948 - DNA, 13 bp, C. elegans
tgaaatcagattt

SEQ ID NO: 728949 - DNA, 13 bp, C. elegans
tgaaatcaggaaa

SEQ ID NO: 728950 - DNA, 13 bp, C. elegans
tgaaatcatcaaa

SEQ ID NO: 728951 - DNA, 13 bp, C. elegans
tgaaatccaatgg

SEQ ID NO: 728952 - DNA, 13 bp, C. elegans
tgaaatccatttt

SEQ ID NO: 728953 - DNA, 13 bp, C. elegans
tgaaatccttaca

SEQ ID NO: 728954 - DNA, 13 bp, C. elegans
tgaaatcgaaaaa

SEQ ID NO: 728955 - DNA, 13 bp, C. elegans
tgaaatcgacgaa

SEQ ID NO: 728956 - DNA, 13 bp, C. elegans
tgaaatcgccgaa

SEQ ID NO: 728957 - DNA, 13 bp, C. elegans
tgaaatcgcttgt

SEQ ID NO: 728958 - DNA, 13 bp, C. elegans
tgaaatctgaaaa

SEQ ID NO: 728959 - DNA, 13 bp, C. elegans
tgaaatctgaaga

SEQ ID NO: 728960 - DNA, 13 bp, C. elegans
tgaaatctgtttt

SEQ ID NO: 728961 - DNA, 13 bp, C. elegans
tgaaatctttgat

SEQ ID NO: 728962 - DNA, 13 bp, C. elegans
tgaaatgaaatga

SEQ ID NO: 728963 - DNA, 13 bp, C. elegans
tgaaatgaaatgc

SEQ ID NO: 728964 - DNA, 13 bp, C. elegans
tgaaatgaacaaa

SEQ ID NO: 728965 - DNA, 13 bp, C. elegans
tgaaatgagcaaa

SEQ ID NO: 728966 - DNA, 13 bp, C. elegans
tgaaatgataata

SEQ ID NO: 728967 - DNA, 13 bp, C. elegans
tgaaatgatgttt

SEQ ID NO: 728968 - DNA, 13 bp, C. elegans
tgaaatgattaaa

SEQ ID NO: 728969 - DNA, 13 bp, C. elegans
tgaaatgattatt

SEQ ID NO: 728970 - DNA, 13 bp, C. elegans
tgaaatgattttt

SEQ ID NO: 728971 - DNA, 13 bp, C. elegans
tgaaatgcaaaaa

SEQ ID NO: 728972 - DNA, 13 bp, C. elegans
tgaaatgctttct

SEQ ID NO: 728973 - DNA, 13 bp, C. elegans
tgaaatggaaatt

SEQ ID NO: 728974 - DNA, 13 bp, C. elegans
tgaaatggaagaa

SEQ ID NO: 728975 - DNA, 13 bp, C. elegans
tgaaatggaattt

SEQ ID NO: 728976 - DNA, 13 bp, C. elegans
tgaaatggcaaaa

SEQ ID NO: 728977 - DNA, 13 bp, C. elegans
tgaaatgtatcaa

SEQ ID NO: 728978 - DNA, 13 bp, C. elegans
tgaaatgtcaatt

SEQ ID NO: 728979 - DNA, 13 bp, C. elegans
tgaaatgtgaaaa

SEQ ID NO: 728980 - DNA, 13 bp, C. elegans
tgaaatgtgaatt

SEQ ID NO: 728981 - DNA, 13 bp, C. elegans
tgaaatgtgcaaa

SEQ ID NO: 728982 - DNA, 13 bp, C. elegans
tgaaatgtgtaaa

SEQ ID NO: 728983 - DNA, 13 bp, C. elegans
tgaaatgtgtgaa

SEQ ID NO: 728984 - DNA, 13 bp, C. elegans
tgaaatgttagaa

SEQ ID NO: 728985 - DNA, 13 bp, C. elegans
tgaaatgttcatt

SEQ ID NO: 728986 - DNA, 13 bp, C. elegans
tgaaatgttccag

SEQ ID NO: 728987 - DNA, 13 bp, C. elegans
tgaaatgttgaaa

SEQ ID NO: 728988 - DNA, 13 bp, C. elegans
tgaaatgtttaaa

SEQ ID NO: 728989 - DNA, 13 bp, C. elegans
tgaaatgtttata

SEQ ID NO: 728990 - DNA, 13 bp, C. elegans
tgaaatgtttatt

SEQ ID NO: 728991 - DNA, 13 bp, C. elegans
tgaaatgtttcga

SEQ ID NO: 728992 - DNA, 13 bp, C. elegans
tgaaatgtttgaa

SEQ ID NO: 728993 - DNA, 13 bp, C. elegans
tgaaatgtttgac

SEQ ID NO: 728994 - DNA, 13 bp, C. elegans
tgaaatgttttaa

SEQ ID NO: 728995 - DNA, 13 bp, C. elegans
tgaaatgttttat

SEQ ID NO: 728996 - DNA, 13 bp, C. elegans
tgaaatgttttgt

SEQ ID NO: 728997 - DNA, 13 bp, C. elegans
tgaaatgttttta

SEQ ID NO: 728998 - DNA, 13 bp, C. elegans
tgaaatgtttttg

SEQ ID NO: 728999 - DNA, 13 bp, C. elegans
tgaaattaaatga

SEQ ID NO: 729000 - DNA, 13 bp, C. elegans
tgaaattaagaat

SEQ ID NO: 729001 - DNA, 13 bp, C. elegans
tgaaattaatcat

SEQ ID NO: 729002 - DNA, 13 bp, C. elegans
tgaaattacaaat

SEQ ID NO: 729003 - DNA, 13 bp, C. elegans
tgaaattacaata

SEQ ID NO: 729004 - DNA, 13 bp, C. elegans
tgaaattacagta

SEQ ID NO: 729005 - DNA, 13 bp, C. elegans
tgaaattacgaat

SEQ ID NO: 729006 - DNA, 13 bp, C. elegans
tgaaattactgtt

SEQ ID NO: 729007 - DNA, 13 bp, C. elegans
tgaaattagattt

SEQ ID NO: 729008 - DNA, 13 bp, C. elegans
tgaaattagcatt

SEQ ID NO: 729009 - DNA, 13 bp, C. elegans
tgaaattagtttt

SEQ ID NO: 729010 - DNA, 13 bp, C. elegans
tgaaattataaca

SEQ ID NO: 729011 - DNA, 13 bp, C. elegans
tgaaattatcaaa

SEQ ID NO: 729012 - DNA, 13 bp, C. elegans
tgaaattatcgat

SEQ ID NO: 729013 - DNA, 13 bp, C. elegans
tgaaattatgaaa

SEQ ID NO: 729014 - DNA, 13 bp, C. elegans
tgaaattatgctt

SEQ ID NO: 729015 - DNA, 13 bp, C. elegans
tgaaattatttca

SEQ ID NO: 729016 - DNA, 13 bp, C. elegans
tgaaattcaatca

SEQ ID NO: 729017 - DNA, 13 bp, C. elegans
tgaaattcaatta

SEQ ID NO: 729018 - DNA, 14 bp, C. elegans
tgaaattccatatt

SEQ ID NO: 729019 - DNA, 14 bp, C. elegans
tgaaattcggaaat

SEQ ID NO: 729020 - DNA, 13 bp, C. elegans
tgaaattcggtgt

SEQ ID NO: 729021 - DNA, 13 bp, C. elegans
tgaaattcgtttt

SEQ ID NO: 729022 - DNA, 13 bp, C. elegans
tgaaattctacaa

SEQ ID NO: 729023 - DNA, 13 bp, C. elegans
tgaaattctcaaa

SEQ ID NO: 729024 - DNA, 13 bp, C. elegans
tgaaattctctta

SEQ ID NO: 729025 - DNA, 13 bp, C. elegans
tgaaattctgaaa

SEQ ID NO: 729026 - DNA, 13 bp, C. elegans
tgaaattcttgat

SEQ ID NO: 729027 - DNA, 13 bp, C. elegans
tgaaattcttgtt

SEQ ID NO: 729028 - DNA, 13 bp, C. elegans
tgaaattcttttt

SEQ ID NO: 729029 - DNA, 13 bp, C. elegans
tgaaattgaaaat

SEQ ID NO: 729030 - DNA, 13 bp, C. elegans
tgaaattgaaact

SEQ ID NO: 729031 - DNA, 13 bp, C. elegans
tgaaattgaaatt

SEQ ID NO: 729032 - DNA, 13 bp, C. elegans
tgaaattgaacaa

SEQ ID NO: 729033 - DNA, 13 bp, C. elegans
tgaaattgaagaa

SEQ ID NO: 729034 - DNA, 13 bp, C. elegans
tgaaattgaagat

SEQ ID NO: 729035 - DNA, 13 bp, C. elegans
tgaaattgaagtt

SEQ ID NO: 729036 - DNA, 13 bp, C. elegans
tgaaattgaataa

SEQ ID NO: 729037 - DNA, 13 bp, C. elegans
tgaaattgaatga

SEQ ID NO: 729038 - DNA, 13 bp, C. elegans
tgaaattgaatta

SEQ ID NO: 729039 - DNA, 13 bp, C. elegans
tgaaattgaattg

SEQ ID NO: 729040 - DNA, 13 bp, C. elegans
tgaaattgaattt

SEQ ID NO: 729041 - DNA, 13 bp, C. elegans
tgaaattgatatt

SEQ ID NO: 729042 - DNA, 13 bp, C. elegans
tgaaattgatgat

SEQ ID NO: 729043 - DNA, 13 bp, C. elegans
tgaaattgattta

SEQ ID NO: 729044 - DNA, 13 bp, C. elegans
tgaaattgatttg

SEQ ID NO: 729045 - DNA, 13 bp, C. elegans
tgaaattgcacaa

SEQ ID NO: 729046 - DNA, 13 bp, C. elegans
tgaaattgcagta

SEQ ID NO: 729047 - DNA, 13 bp, C. elegans
tgaaattgcagtt

SEQ ID NO: 729048 - DNA, 13 bp, C. elegans
tgaaattgcattc

SEQ ID NO: 729049 - DNA, 13 bp, C. elegans
tgaaattgcattt

SEQ ID NO: 729050 - DNA, 13 bp, C. elegans
tgaaattgctcaa

SEQ ID NO: 729051 - DNA, 13 bp, C. elegans
tgaaattggaatt

SEQ ID NO: 729052 - DNA, 13 bp, C. elegans
tgaaattggatat

SEQ ID NO: 729053 - DNA, 13 bp, C. elegans
tgaaattggtaaa

SEQ ID NO: 729054 - DNA, 13 bp, C. elegans
tgaaattgtagaa

SEQ ID NO: 729055 - DNA, 13 bp, C. elegans
tgaaattgtagat

SEQ ID NO: 729056 - DNA, 13 bp, C. elegans
tgaaattgtataa

SEQ ID NO: 729057 - DNA, 13 bp, C. elegans
tgaaattgtgaaa

SEQ ID NO: 729058 - DNA, 13 bp, C. elegans
tgaaattgtgata

SEQ ID NO: 729059 - DNA, 13 bp, C. elegans
tgaaattgtggaa

SEQ ID NO: 729060 - DNA, 13 bp, C. elegans
tgaaattgtgtta

SEQ ID NO: 729061 - DNA, 13 bp, C. elegans
tgaaattgttatt

SEQ ID NO: 729062 - DNA, 13 bp, C. elegans
tgaaattgttgaa

SEQ ID NO: 729063 - DNA, 13 bp, C. elegans
tgaaattgttgat

SEQ ID NO: 729064 - DNA, 13 bp, C. elegans
tgaaattgttgga

SEQ ID NO: 729065 - DNA, 13 bp, C. elegans
tgaaattgtttct

SEQ ID NO: 729066 - DNA, 13 bp, C. elegans
tgaaattgtttga

SEQ ID NO: 729067 - DNA, 13 bp, C. elegans
tgaaattgttttg

SEQ ID NO: 729068 - DNA, 13 bp, C. elegans
tgaaatttaaaga

SEQ ID NO: 729069 - DNA, 13 bp, C. elegans
tgaaatttatagt

SEQ ID NO: 729070 - DNA, 13 bp, C. elegans
tgaaatttatcat

SEQ ID NO: 729071 - DNA, 13 bp, C. elegans
tgaaatttatgca

SEQ ID NO: 729072 - DNA, 13 bp, C. elegans
tgaaatttattgt

SEQ ID NO: 729073 - DNA, 13 bp, C. elegans
tgaaatttcaaac

SEQ ID NO: 729074 - DNA, 13 bp, C. elegans
tgaaatttcaaag

SEQ ID NO: 729075 - DNA, 13 bp, C. elegans
tgaaatttcaagt

SEQ ID NO: 729076 - DNA, 13 bp, C. elegans
tgaaatttcgaaa

SEQ ID NO: 729077 - DNA, 13 bp, C. elegans
tgaaatttcgatt

SEQ ID NO: 729078 - DNA, 13 bp, C. elegans
tgaaatttcgtca

SEQ ID NO: 729079 - DNA, 13 bp, C. elegans
tgaaatttctaaa

SEQ ID NO: 729080 - DNA, 13 bp, C. elegans
tgaaatttctgag

SEQ ID NO: 729081 - DNA, 13 bp, C. elegans
tgaaatttctggc

SEQ ID NO: 729082 - DNA, 13 bp, C. elegans
tgaaatttgaaaa

SEQ ID NO: 729083 - DNA, 13 bp, C. elegans
tgaaatttgatga

SEQ ID NO: 729084 - DNA, 13 bp, C. elegans
tgaaatttgcaca

SEQ ID NO: 729085 - DNA, 13 bp, C. elegans
tgaaatttgcttt

SEQ ID NO: 729086 - DNA, 13 bp, C. elegans
tgaaatttggaat

SEQ ID NO: 729087 - DNA, 13 bp, C. elegans
tgaaatttgggat

SEQ ID NO: 729088 - DNA, 13 bp, C. elegans
tgaaatttgtaaa

SEQ ID NO: 729089 - DNA, 13 bp, C. elegans
tgaaatttgtaga

SEQ ID NO: 729090 - DNA, 13 bp, C. elegans
tgaaatttgttca

SEQ ID NO: 729091 - DNA, 13 bp, C. elegans
tgaaatttgtttc

SEQ ID NO: 729092 - DNA, 13 bp, C. elegans
tgaaattttagtt

SEQ ID NO: 729093 - DNA, 13 bp, C. elegans
tgaaattttatca

SEQ ID NO: 729094 - DNA, 13 bp, C. elegans
tgaaattttatcg

SEQ ID NO: 729095 - DNA, 14 bp, C. elegans
tgaaattttcaaaa

SEQ ID NO: 729096 - DNA, 13 bp, C. elegans
tgaaattttcacg

SEQ ID NO: 729097 - DNA, 13 bp, C. elegans
tgaaattttcatt

SEQ ID NO: 729098 - DNA, 13 bp, C. elegans
tgaaattttcgaa

SEQ ID NO: 729099 - DNA, 14 bp, C. elegans
tgaaattttgaaat

SEQ ID NO: 729100 - DNA, 13 bp, C. elegans
tgaaattttgcag

SEQ ID NO: 729101 - DNA, 13 bp, C. elegans
tgaaattttggat

SEQ ID NO: 729102 - DNA, 13 bp, C. elegans
tgaaattttgtat

SEQ ID NO: 729103 - DNA, 13 bp, C. elegans
tgaaatttttagg

SEQ ID NO: 729104 - DNA, 13 bp, C. elegans
tgaaatttttcaa

SEQ ID NO: 729105 - DNA, 13 bp, C. elegans
tgaaatttttcag

SEQ ID NO: 729106 - DNA, 13 bp, C. elegans
tgaaatttttgaa

SEQ ID NO: 729107 - DNA, 13 bp, C. elegans
tgaaatttttgac

SEQ ID NO: 729108 - DNA, 13 bp, C. elegans
tgaaatttttgat

SEQ ID NO: 729109 - DNA, 13 bp, C. elegans
tgaaatttttgga

SEQ ID NO: 729110 - DNA, 13 bp, C. elegans
tgaaatttttgtg

SEQ ID NO: 729111 - DNA, 13 bp, C. elegans
tgaaattttttgc

SEQ ID NO: 729112 - DNA, 13 bp, C. elegans
tgaacaaaaacat

SEQ ID NO: 729113 - DNA, 13 bp, C. elegans
tgaacaaaaacta

SEQ ID NO: 729114 - DNA, 13 bp, C. elegans
tgaacaaaaatta

SEQ ID NO: 729115 - DNA, 13 bp, C. elegans
tgaacaaaaattt

SEQ ID NO: 729116 - DNA, 13 bp, C. elegans
tgaacaaaacaat

SEQ ID NO: 729117 - DNA, 13 bp, C. elegans
tgaacaaaatcaa

SEQ ID NO: 729118 - DNA, 13 bp, C. elegans
tgaacaaaatcta

SEQ ID NO: 729119 - DNA, 13 bp, C. elegans
tgaacaaaatttt

SEQ ID NO: 729120 - DNA, 13 bp, C. elegans
tgaacaaactttt

SEQ ID NO: 729121 - DNA, 13 bp, C. elegans
tgaacaaatatca

SEQ ID NO: 729122 - DNA, 13 bp, C. elegans
tgaacaaatcaaa

SEQ ID NO: 729123 - DNA, 13 bp, C. elegans
tgaacaaatttga

SEQ ID NO: 729124 - DNA, 13 bp, C. elegans
tgaacaaatttgt

SEQ ID NO: 729125 - DNA, 13 bp, C. elegans
tgaacaactttgt

SEQ ID NO: 729126 - DNA, 13 bp, C. elegans
tgaacaacttttt

SEQ ID NO: 729127 - DNA, 13 bp, C. elegans
tgaacaagaagaa

SEQ ID NO: 729128 - DNA, 13 bp, C. elegans
tgaacaagaattt

SEQ ID NO: 729129 - DNA, 13 bp, C. elegans
tgaacaatatttg

SEQ ID NO: 729130 - DNA, 13 bp, C. elegans
tgaacaatatttt

SEQ ID NO: 729131 - DNA, 13 bp, C. elegans
tgaacaatgatct

SEQ ID NO: 729132 - DNA, 13 bp, C. elegans
tgaacaattaaat

SEQ ID NO: 729133 - DNA, 13 bp, C. elegans
tgaacaattaatt

SEQ ID NO: 729134 - DNA, 13 bp, C. elegans
tgaacaattgaat

SEQ ID NO: 729135 - DNA, 13 bp, C. elegans
tgaacaatttatt

SEQ ID NO: 729136 - DNA, 13 bp, C. elegans
tgaacaatttgaa

SEQ ID NO: 729137 - DNA, 13 bp, C. elegans
tgaacaattttta

SEQ ID NO: 729138 - DNA, 13 bp, C. elegans
tgaacaatttttt

SEQ ID NO: 729139 - DNA, 13 bp, C. elegans
tgaacacaatttt

SEQ ID NO: 729140 - DNA, 13 bp, C. elegans
tgaacactgaaaa

SEQ ID NO: 729141 - DNA, 13 bp, C. elegans
tgaacactttgaa

SEQ ID NO: 729142 - DNA, 13 bp, C. elegans
tgaacactttttg

SEQ ID NO: 729143 - DNA, 13 bp, C. elegans
tgaacactttttt

SEQ ID NO: 729144 - DNA, 13 bp, C. elegans
tgaacagattttt

SEQ ID NO: 729145 - DNA, 13 bp, C. elegans
tgaacagttcaaa

SEQ ID NO: 729146 - DNA, 13 bp, C. elegans
tgaacagtttcaa

SEQ ID NO: 729147 - DNA, 13 bp, C. elegans
tgaacagttttat

SEQ ID NO: 729148 - DNA, 13 bp, C. elegans
tgaacagtttttt

SEQ ID NO: 729149 - DNA, 13 bp, C. elegans
tgaacataaattt

SEQ ID NO: 729150 - DNA, 13 bp, C. elegans
tgaacatatattt

SEQ ID NO: 729151 - DNA, 13 bp, C. elegans
tgaacatattcaa

SEQ ID NO: 729152 - DNA, 13 bp, C. elegans
tgaacatattgaa

SEQ ID NO: 729153 - DNA, 13 bp, C. elegans
tgaacatcaaaga

SEQ ID NO: 729154 - DNA, 13 bp, C. elegans
tgaacatccaaac

SEQ ID NO: 729155 - DNA, 13 bp, C. elegans
tgaacatgaaatt

SEQ ID NO: 729156 - DNA, 13 bp, C. elegans
tgaacattctaga

SEQ ID NO: 729157 - DNA, 13 bp, C. elegans
tgaacatttcatt

SEQ ID NO: 729158 - DNA, 13 bp, C. elegans
tgaacatttctga

SEQ ID NO: 729159 - DNA, 13 bp, C. elegans
tgaacatttgttt

SEQ ID NO: 729160 - DNA, 13 bp, C. elegans
tgaacattttcag

SEQ ID NO: 729161 - DNA, 13 bp, C. elegans
tgaacattttccg

SEQ ID NO: 729162 - DNA, 13 bp, C. elegans
tgaacattttgac

SEQ ID NO: 729163 - DNA, 13 bp, C. elegans
tgaacattttgtt

SEQ ID NO: 729164 - DNA, 13 bp, C. elegans
tgaacatttttag

SEQ ID NO: 729165 - DNA, 13 bp, C. elegans
tgaacatttttca

SEQ ID NO: 729166 - DNA, 13 bp, C. elegans
tgaacatttttct

SEQ ID NO: 729167 - DNA, 13 bp, C. elegans
tgaacatttttta

SEQ ID NO: 729168 - DNA, 13 bp, C. elegans
tgaacattttttg

SEQ ID NO: 729169 - DNA, 13 bp, C. elegans
tgaaccaaaaact

SEQ ID NO: 729170 - DNA, 13 bp, C. elegans
tgaaccaaaatca

SEQ ID NO: 729171 - DNA, 13 bp, C. elegans
tgaaccaataaaa

SEQ ID NO: 729172 - DNA, 13 bp, C. elegans
tgaaccgattttc

SEQ ID NO: 729173 - DNA, 13 bp, C. elegans
tgaacctattttt

SEQ ID NO: 729174 - DNA, 13 bp, C. elegans
tgaacgaaaattg

SEQ ID NO: 729175 - DNA, 13 bp, C. elegans
tgaacgtcgagac

SEQ ID NO: 729176 - DNA, 13 bp, C. elegans
tgaacgttatttc

SEQ ID NO: 729177 - DNA, 13 bp, C. elegans
tgaacgttttcaa

SEQ ID NO: 729178 - DNA, 13 bp, C. elegans
tgaacgttttttt

SEQ ID NO: 729179 - DNA, 13 bp, C. elegans
tgaactattgttt

SEQ ID NO: 729180 - DNA, 13 bp, C. elegans
tgaactcaaaaaa

SEQ ID NO: 729181 - DNA, 13 bp, C. elegans
tgaactcaaactt

SEQ ID NO: 729182 - DNA, 13 bp, C. elegans
tgaactcaaatat

SEQ ID NO: 729183 - DNA, 13 bp, C. elegans
tgaactctttgaa

SEQ ID NO: 729184 - DNA, 13 bp, C. elegans
tgaactgaaaata

SEQ ID NO: 729185 - DNA, 13 bp, C. elegans
tgaactgattaaa

SEQ ID NO: 729186 - DNA, 13 bp, C. elegans
tgaactgattttt

SEQ ID NO: 729187 - DNA, 23 bp, C. elegans
tgaacttatcgcgtaagcgacct

SEQ ID NO: 729188 - DNA, 14 bp, C. elegans
tgaacttcaaaaaa

SEQ ID NO: 729189 - DNA, 13 bp, C. elegans
tgaacttgaattt

SEQ ID NO: 729190 - DNA, 13 bp, C. elegans
tgaacttggtttt

SEQ ID NO: 729191 - DNA, 13 bp, C. elegans
tgaactttaaatt

SEQ ID NO: 729192 - DNA, 13 bp, C. elegans
tgaactttcaaaa

SEQ ID NO: 729193 - DNA, 13 bp, C. elegans
tgaactttcacat

SEQ ID NO: 729194 - DNA, 13 bp, C. elegans
tgaactttgtgaa

SEQ ID NO: 729195 - DNA, 13 bp, C. elegans
tgaacttttaaat

SEQ ID NO: 729196 - DNA, 13 bp, C. elegans
tgaacttttatga

SEQ ID NO: 729197 - DNA, 13 bp, C. elegans
tgaacttttcaaa

SEQ ID NO: 729198 - DNA, 13 bp, C. elegans
tgaacttttcaat

SEQ ID NO: 729199 - DNA, 13 bp, C. elegans
tgaacttttgaaa

SEQ ID NO: 729200 - DNA, 13 bp, C. elegans
tgaacttttgaat

SEQ ID NO: 729201 - DNA, 13 bp, C. elegans
tgaactttttaca

SEQ ID NO: 729202 - DNA, 13 bp, C. elegans
tgaactttttcaa

SEQ ID NO: 729203 - DNA, 13 bp, C. elegans
tgaactttttcag

SEQ ID NO: 729204 - DNA, 13 bp, C. elegans
tgaactttttcga

SEQ ID NO: 729205 - DNA, 13 bp, C. elegans
tgaactttttctg

SEQ ID NO: 729206 - DNA, 13 bp, C. elegans
tgaacttttttca

SEQ ID NO: 729207 - DNA, 13 bp, C. elegans
tgaacttttttga

SEQ ID NO: 729208 - DNA, 13 bp, C. elegans
tgaacttttttgt

SEQ ID NO: 729209 - DNA, 13 bp, C. elegans
tgaagaaaaagtc

SEQ ID NO: 729210 - DNA, 13 bp, C. elegans
tgaagaaaaattt

SEQ ID NO: 729211 - DNA, 13 bp, C. elegans
tgaagaaaacgag

SEQ ID NO: 729212 - DNA, 13 bp, C. elegans
tgaagaaaactat

SEQ ID NO: 729213 - DNA, 14 bp, C. elegans
tgaagaaaatcaat

SEQ ID NO: 729214 - DNA, 13 bp, C. elegans
tgaagaaaatgat

SEQ ID NO: 729215 - DNA, 13 bp, C. elegans
tgaagaaaattgt

SEQ ID NO: 729216 - DNA, 13 bp, C. elegans
tgaagaaaattta

SEQ ID NO: 729217 - DNA, 13 bp, C. elegans
tgaagaaattcga

SEQ ID NO: 729218 - DNA, 13 bp, C. elegans
tgaagaaattgag

SEQ ID NO: 729219 - DNA, 13 bp, C. elegans
tgaagaaatttga

SEQ ID NO: 729220 - DNA, 13 bp, C. elegans
tgaagaaattttg

SEQ ID NO: 729221 - DNA, 13 bp, C. elegans
tgaagaacatgaa

SEQ ID NO: 729222 - DNA, 13 bp, C. elegans
tgaagaagaacat

SEQ ID NO: 729223 - DNA, 13 bp, C. elegans
tgaagaagaccta

SEQ ID NO: 729224 - DNA, 13 bp, C. elegans
tgaagaagatgaa

SEQ ID NO: 729225 - DNA, 13 bp, C. elegans
tgaagaagatgat

SEQ ID NO: 729226 - DNA, 13 bp, C. elegans
tgaagaagttttg

SEQ ID NO: 729227 - DNA, 13 bp, C. elegans
tgaagaagttttt

SEQ ID NO: 729228 - DNA, 13 bp, C. elegans
tgaagaataacaa

SEQ ID NO: 729229 - DNA, 13 bp, C. elegans
tgaagaataatat

SEQ ID NO: 729230 - DNA, 13 bp, C. elegans
tgaagaataattt

SEQ ID NO: 729231 - DNA, 13 bp, C. elegans
tgaagaatatttt

SEQ ID NO: 729232 - DNA, 13 bp, C. elegans
tgaagaatgaaga

SEQ ID NO: 729233 - DNA, 13 bp, C. elegans
tgaagaattagaa

SEQ ID NO: 729234 - DNA, 13 bp, C. elegans
tgaagaattgaat

SEQ ID NO: 729235 - DNA, 13 bp, C. elegans
tgaagaattgttt

SEQ ID NO: 729236 - DNA, 13 bp, C. elegans
tgaagaatttctg

SEQ ID NO: 729237 - DNA, 13 bp, C. elegans
tgaagaatttgaa

SEQ ID NO: 729238 - DNA, 13 bp, C. elegans
tgaagacaaaaat

SEQ ID NO: 729239 - DNA, 13 bp, C. elegans
tgaagaccaaaac

SEQ ID NO: 729240 - DNA, 13 bp, C. elegans
tgaagacgaagaa

SEQ ID NO: 729241 - DNA, 14 bp, C. elegans
tgaagacgtcttca

SEQ ID NO: 729242 - DNA, 13 bp, C. elegans
tgaagagatttat

SEQ ID NO: 729243 - DNA, 13 bp, C. elegans
tgaagataaattt

SEQ ID NO: 729244 - DNA, 13 bp, C. elegans
tgaagataatatt

SEQ ID NO: 729245 - DNA, 13 bp, C. elegans
tgaagatattgaa

SEQ ID NO: 729246 - DNA, 13 bp, C. elegans
tgaagatatttga

SEQ ID NO: 729247 - DNA, 13 bp, C. elegans
tgaagatcaaagc

SEQ ID NO: 729248 - DNA, 13 bp, C. elegans
tgaagatcaaatc

SEQ ID NO: 729249 - DNA, 13 bp, C. elegans
tgaagatgagcaa

SEQ ID NO: 729250 - DNA, 13 bp, C. elegans
tgaagatgaggaa

SEQ ID NO: 729251 - DNA, 13 bp, C. elegans
tgaagatgatgaa

SEQ ID NO: 729252 - DNA, 13 bp, C. elegans
tgaagatggaaaa

SEQ ID NO: 729253 - DNA, 13 bp, C. elegans
tgaagatgtggaa

SEQ ID NO: 729254 - DNA, 13 bp, C. elegans
tgaagattcagtt

SEQ ID NO: 729255 - DNA, 13 bp, C. elegans
tgaagattgaaaa

SEQ ID NO: 729256 - DNA, 13 bp, C. elegans
tgaagatttataa

SEQ ID NO: 729257 - DNA, 13 bp, C. elegans
tgaagatttcgaa

SEQ ID NO: 729258 - DNA, 13 bp, C. elegans
tgaagattttcag

SEQ ID NO: 729259 - DNA, 13 bp, C. elegans
tgaagattttcat

SEQ ID NO: 729260 - DNA, 13 bp, C. elegans
tgaagattttctg

SEQ ID NO: 729261 - DNA, 13 bp, C. elegans
tgaagattttgga

SEQ ID NO: 729262 - DNA, 13 bp, C. elegans
tgaagatttttat

SEQ ID NO: 729263 - DNA, 13 bp, C. elegans
tgaagcaaaaaac

SEQ ID NO: 729264 - DNA, 13 bp, C. elegans
tgaagcaacaaaa

SEQ ID NO: 729265 - DNA, 14 bp, C. elegans
tgaagcaaggaatt

SEQ ID NO: 729266 - DNA, 13 bp, C. elegans
tgaagcataattt

SEQ ID NO: 729267 - DNA, 13 bp, C. elegans
tgaagcattttct

SEQ ID NO: 729268 - DNA, 13 bp, C. elegans
tgaagcattttta

SEQ ID NO: 729269 - DNA, 13 bp, C. elegans
tgaagcatttttc

SEQ ID NO: 729270 - DNA, 13 bp, C. elegans
tgaagccaaaaat

SEQ ID NO: 729271 - DNA, 13 bp, C. elegans
tgaagccatagag

SEQ ID NO: 729272 - DNA, 13 bp, C. elegans
tgaagctagaaaa

SEQ ID NO: 729273 - DNA, 13 bp, C. elegans
tgaagcttcaaaa

SEQ ID NO: 729274 - DNA, 13 bp, C. elegans
tgaagcttcagaa

SEQ ID NO: 729275 - DNA, 13 bp, C. elegans
tgaagcttgaaaa

SEQ ID NO: 729276 - DNA, 13 bp, C. elegans
tgaaggaaaatgt

SEQ ID NO: 729277 - DNA, 13 bp, C. elegans
tgaaggaaattga

SEQ ID NO: 729278 - DNA, 13 bp, C. elegans
tgaaggaaatttt

SEQ ID NO: 729279 - DNA, 13 bp, C. elegans
tgaaggaatacag

SEQ ID NO: 729280 - DNA, 13 bp, C. elegans
tgaaggcaggtag

SEQ ID NO: 729281 - DNA, 14 bp, C. elegans
tgaagggacaagtt

SEQ ID NO: 729282 - DNA, 13 bp, C. elegans
tgaagtcaaaaaa

SEQ ID NO: 729283 - DNA, 13 bp, C. elegans
tgaagtcaatttt

SEQ ID NO: 729284 - DNA, 13 bp, C. elegans
tgaagtcagaaaa

SEQ ID NO: 729285 - DNA, 13 bp, C. elegans
tgaagtcattttt

SEQ ID NO: 729286 - DNA, 13 bp, C. elegans
tgaagttagaaaa

SEQ ID NO: 729287 - DNA, 13 bp, C. elegans
tgaagttataaaa

SEQ ID NO: 729288 - DNA, 13 bp, C. elegans
tgaagttatcaaa

SEQ ID NO: 729289 - DNA, 13 bp, C. elegans
tgaagttcaaata

SEQ ID NO: 729290 - DNA, 13 bp, C. elegans
tgaagttcaaatt

SEQ ID NO: 729291 - DNA, 13 bp, C. elegans
tgaagttcaattt

SEQ ID NO: 729292 - DNA, 13 bp, C. elegans
tgaagttgaaaat

SEQ ID NO: 729293 - DNA, 13 bp, C. elegans
tgaagttggaaat

SEQ ID NO: 729294 - DNA, 13 bp, C. elegans
tgaagttgtggaa

SEQ ID NO: 729295 - DNA, 13 bp, C. elegans
tgaagtttatgaa

SEQ ID NO: 729296 - DNA, 13 bp, C. elegans
tgaagtttcaact

SEQ ID NO: 729297 - DNA, 13 bp, C. elegans
tgaagtttcaata

SEQ ID NO: 729298 - DNA, 13 bp, C. elegans
tgaagtttctgaa

SEQ ID NO: 729299 - DNA, 13 bp, C. elegans
tgaagttttaaaa

SEQ ID NO: 729300 - DNA, 13 bp, C. elegans
tgaagttttaata

SEQ ID NO: 729301 - DNA, 13 bp, C. elegans
tgaagttttcaat

SEQ ID NO: 729302 - DNA, 13 bp, C. elegans
tgaagttttcatt

SEQ ID NO: 729303 - DNA, 13 bp, C. elegans
tgaagttttgaag

SEQ ID NO: 729304 - DNA, 13 bp, C. elegans
tgaagttttggct

SEQ ID NO: 729305 - DNA, 13 bp, C. elegans
tgaagtttttctc

SEQ ID NO: 729306 - DNA, 13 bp, C. elegans
tgaataaaaatca

SEQ ID NO: 729307 - DNA, 13 bp, C. elegans
tgaataaaaattg

SEQ ID NO: 729308 - DNA, 13 bp, C. elegans
tgaataaaacttg

SEQ ID NO: 729309 - DNA, 13 bp, C. elegans
tgaataaaattca

SEQ ID NO: 729310 - DNA, 13 bp, C. elegans
tgaataaaattga

SEQ ID NO: 729311 - DNA, 13 bp, C. elegans
tgaataaacaaat

SEQ ID NO: 729312 - DNA, 13 bp, C. elegans
tgaataaagtttt

SEQ ID NO: 729313 - DNA, 13 bp, C. elegans
tgaataaatgtat

SEQ ID NO: 729314 - DNA, 13 bp, C. elegans
tgaataaatgttt

SEQ ID NO: 729315 - DNA, 13 bp, C. elegans
tgaataaattcag

SEQ ID NO: 729316 - DNA, 13 bp, C. elegans
tgaataaattgaa

SEQ ID NO: 729317 - DNA, 13 bp, C. elegans
tgaataaatttca

SEQ ID NO: 729318 - DNA, 13 bp, C. elegans
tgaataaatttcc

SEQ ID NO: 729319 - DNA, 13 bp, C. elegans
tgaataaattttc

SEQ ID NO: 729320 - DNA, 13 bp, C. elegans
tgaataacatatc

SEQ ID NO: 729321 - DNA, 13 bp, C. elegans
tgaataacttttc

SEQ ID NO: 729322 - DNA, 13 bp, C. elegans
tgaataacttttt

SEQ ID NO: 729323 - DNA, 13 bp, C. elegans
tgaataattgttg

SEQ ID NO: 729324 - DNA, 13 bp, C. elegans
tgaataatttcaa

SEQ ID NO: 729325 - DNA, 13 bp, C. elegans
tgaataattttac

SEQ ID NO: 729326 - DNA, 13 bp, C. elegans
tgaatacaaattt

SEQ ID NO: 729327 - DNA, 13 bp, C. elegans
tgaatacaataaa

SEQ ID NO: 729328 - DNA, 13 bp, C. elegans
tgaatacacaatt

SEQ ID NO: 729329 - DNA, 13 bp, C. elegans
tgaatacagttgt

SEQ ID NO: 729330 - DNA, 13 bp, C. elegans
tgaatacatttat

SEQ ID NO: 729331 - DNA, 13 bp, C. elegans
tgaatacctagaa

SEQ ID NO: 729332 - DNA, 13 bp, C. elegans
tgaatactttatt

SEQ ID NO: 729333 - DNA, 13 bp, C. elegans
tgaatactttcaa

SEQ ID NO: 729334 - DNA, 13 bp, C. elegans
tgaatactttcag

SEQ ID NO: 729335 - DNA, 13 bp, C. elegans
tgaatagatattt

SEQ ID NO: 729336 - DNA, 13 bp, C. elegans
tgaatagattttt

SEQ ID NO: 729337 - DNA, 13 bp, C. elegans
tgaatagtttgaa

SEQ ID NO: 729338 - DNA, 13 bp, C. elegans
tgaatatattcaa

SEQ ID NO: 729339 - DNA, 13 bp, C. elegans
tgaatatcataat

SEQ ID NO: 729340 - DNA, 13 bp, C. elegans
tgaatatctcaaa

SEQ ID NO: 729341 - DNA, 13 bp, C. elegans
tgaatatctgaaa

SEQ ID NO: 729342 - DNA, 13 bp, C. elegans
tgaatatcttgaa

SEQ ID NO: 729343 - DNA, 13 bp, C. elegans
tgaatatgaaatg

SEQ ID NO: 729344 - DNA, 13 bp, C. elegans
tgaatatgaatat

SEQ ID NO: 729345 - DNA, 13 bp, C. elegans
tgaatatgaattt

SEQ ID NO: 729346 - DNA, 13 bp, C. elegans
tgaatatgatttt

SEQ ID NO: 729347 - DNA, 13 bp, C. elegans
tgaatatggaaaa

SEQ ID NO: 729348 - DNA, 13 bp, C. elegans
tgaatatggaatt

SEQ ID NO: 729349 - DNA, 13 bp, C. elegans
tgaatattcaaaa

SEQ ID NO: 729350 - DNA, 13 bp, C. elegans
tgaatattcaaat

SEQ ID NO: 729351 - DNA, 13 bp, C. elegans
tgaatattcaacg

SEQ ID NO: 729352 - DNA, 13 bp, C. elegans
tgaatatttatgt

SEQ ID NO: 729353 - DNA, 13 bp, C. elegans
tgaatatttctat

SEQ ID NO: 729354 - DNA, 13 bp, C. elegans
tgaatatttgaaa

SEQ ID NO: 729355 - DNA, 13 bp, C. elegans
tgaatatttgatt

SEQ ID NO: 729356 - DNA, 13 bp, C. elegans
tgaatatttgtaa

SEQ ID NO: 729357 - DNA, 13 bp, C. elegans
tgaatatttgtgt

SEQ ID NO: 729358 - DNA, 13 bp, C. elegans
tgaatattttcag

SEQ ID NO: 729359 - DNA, 13 bp, C. elegans
tgaatattttctc

SEQ ID NO: 729360 - DNA, 13 bp, C. elegans
tgaatattttgaa

SEQ ID NO: 729361 - DNA, 13 bp, C. elegans
tgaatatttttca

SEQ ID NO: 729362 - DNA, 13 bp, C. elegans
tgaatatttttct

SEQ ID NO: 729363 - DNA, 13 bp, C. elegans
tgaatcaaattga

SEQ ID NO: 729364 - DNA, 13 bp, C. elegans
tgaatcaacaaaa

SEQ ID NO: 729365 - DNA, 13 bp, C. elegans
tgaatcacttttc

SEQ ID NO: 729366 - DNA, 13 bp, C. elegans
tgaatcagattat

SEQ ID NO: 729367 - DNA, 13 bp, C. elegans
tgaatcagcacca

SEQ ID NO: 729368 - DNA, 13 bp, C. elegans
tgaatcatcaatt

SEQ ID NO: 729369 - DNA, 13 bp, C. elegans
tgaatccaaattt

SEQ ID NO: 729370 - DNA, 13 bp, C. elegans
tgaatcctttttt

SEQ ID NO: 729371 - DNA, 13 bp, C. elegans
tgaatctagaaaa

SEQ ID NO: 729372 - DNA, 13 bp, C. elegans
tgaatctcaagaa

SEQ ID NO: 729373 - DNA, 13 bp, C. elegans
tgaatctcttttt

SEQ ID NO: 729374 - DNA, 13 bp, C. elegans
tgaatctgaaaat

SEQ ID NO: 729375 - DNA, 13 bp, C. elegans
tgaatctgaaatt

SEQ ID NO: 729376 - DNA, 13 bp, C. elegans
tgaatcttcaaaa

SEQ ID NO: 729377 - DNA, 13 bp, C. elegans
tgaatcttttaaa

SEQ ID NO: 729378 - DNA, 13 bp, C. elegans
tgaatgaaaaatt

SEQ ID NO: 729379 - DNA, 13 bp, C. elegans
tgaatgaaaatcg

SEQ ID NO: 729380 - DNA, 13 bp, C. elegans
tgaatgaaacttt

SEQ ID NO: 729381 - DNA, 13 bp, C. elegans
tgaatgaaataat

SEQ ID NO: 729382 - DNA, 13 bp, C. elegans
tgaatgaaattga

SEQ ID NO: 729383 - DNA, 13 bp, C. elegans
tgaatgaaatttt

SEQ ID NO: 729384 - DNA, 13 bp, C. elegans
tgaatgaatctat

SEQ ID NO: 729385 - DNA, 13 bp, C. elegans
tgaatgagttgtt

SEQ ID NO: 729386 - DNA, 13 bp, C. elegans
tgaatgatttgaa

SEQ ID NO: 729387 - DNA, 13 bp, C. elegans
tgaatgattttca

SEQ ID NO: 729388 - DNA, 13 bp, C. elegans
tgaatgcataatt

SEQ ID NO: 729389 - DNA, 13 bp, C. elegans
tgaatggaaataa

SEQ ID NO: 729390 - DNA, 13 bp, C. elegans
tgaatggaaatgt

SEQ ID NO: 729391 - DNA, 13 bp, C. elegans
tgaatggattttt

SEQ ID NO: 729392 - DNA, 13 bp, C. elegans
tgaatggcaaaaa

SEQ ID NO: 729393 - DNA, 13 bp, C. elegans
tgaatggcagaaa

SEQ ID NO: 729394 - DNA, 13 bp, C. elegans
tgaatgggaaaat

SEQ ID NO: 729395 - DNA, 13 bp, C. elegans
tgaatgtaatttt

SEQ ID NO: 729396 - DNA, 13 bp, C. elegans
tgaatgttatttc

SEQ ID NO: 729397 - DNA, 13 bp, C. elegans
tgaatgttttcaa

SEQ ID NO: 729398 - DNA, 13 bp, C. elegans
tgaatgttttcag

SEQ ID NO: 729399 - DNA, 13 bp, C. elegans
tgaatgttttgat

SEQ ID NO: 729400 - DNA, 13 bp, C. elegans
tgaatgtttttct

SEQ ID NO: 729401 - DNA, 13 bp, C. elegans
tgaattaaacatt

SEQ ID NO: 729402 - DNA, 13 bp, C. elegans
tgaattagaaaat

SEQ ID NO: 729403 - DNA, 13 bp, C. elegans
tgaattattagaa

SEQ ID NO: 729404 - DNA, 13 bp, C. elegans
tgaattattcaga

SEQ ID NO: 729405 - DNA, 13 bp, C. elegans
tgaattattcgaa

SEQ ID NO: 729406 - DNA, 13 bp, C. elegans
tgaattatttcga

SEQ ID NO: 729407 - DNA, 13 bp, C. elegans
tgaattatttgaa

SEQ ID NO: 729408 - DNA, 13 bp, C. elegans
tgaattcaaaaat

SEQ ID NO: 729409 - DNA, 13 bp, C. elegans
tgaattcaaatca

SEQ ID NO: 729410 - DNA, 13 bp, C. elegans
tgaattcaattaa

SEQ ID NO: 729411 - DNA, 13 bp, C. elegans
tgaattcacaatt

SEQ ID NO: 729412 - DNA, 13 bp, C. elegans
tgaattcagaaaa

SEQ ID NO: 729413 - DNA, 13 bp, C. elegans
tgaattcattatt

SEQ ID NO: 729414 - DNA, 13 bp, C. elegans
tgaattcgaaaaa

SEQ ID NO: 729415 - DNA, 13 bp, C. elegans
tgaattcgatttt

SEQ ID NO: 729416 - DNA, 13 bp, C. elegans
tgaattctaaatt

SEQ ID NO: 729417 - DNA, 13 bp, C. elegans
tgaattctcaata

SEQ ID NO: 729418 - DNA, 13 bp, C. elegans
tgaattctctgaa

SEQ ID NO: 729419 - DNA, 13 bp, C. elegans
tgaattctgaaaa

SEQ ID NO: 729420 - DNA, 13 bp, C. elegans
tgaattcttgaaa

SEQ ID NO: 729421 - DNA, 13 bp, C. elegans
tgaattcttgaat

SEQ ID NO: 729422 - DNA, 13 bp, C. elegans
tgaattgaaatga

SEQ ID NO: 729423 - DNA, 13 bp, C. elegans
tgaattgaacttt

SEQ ID NO: 729424 - DNA, 13 bp, C. elegans
tgaattgaatttg

SEQ ID NO: 729425 - DNA, 13 bp, C. elegans
tgaattgagaaaa

SEQ ID NO: 729426 - DNA, 13 bp, C. elegans
tgaattggaaatg

SEQ ID NO: 729427 - DNA, 13 bp, C. elegans
tgaattggaagaa

SEQ ID NO: 729428 - DNA, 13 bp, C. elegans
tgaattggctgaa

SEQ ID NO: 729429 - DNA, 13 bp, C. elegans
tgaattgtattta

SEQ ID NO: 729430 - DNA, 13 bp, C. elegans
tgaattgtgaatt

SEQ ID NO: 729431 - DNA, 13 bp, C. elegans
tgaattgtttcaa

SEQ ID NO: 729432 - DNA, 13 bp, C. elegans
tgaattgttttct

SEQ ID NO: 729433 - DNA, 13 bp, C. elegans
tgaattgtttttc

SEQ ID NO: 729434 - DNA, 13 bp, C. elegans
tgaatttaaatca

SEQ ID NO: 729435 - DNA, 13 bp, C. elegans
tgaatttaagaaa

SEQ ID NO: 729436 - DNA, 13 bp, C. elegans
tgaatttaatgaa

SEQ ID NO: 729437 - DNA, 13 bp, C. elegans
tgaatttaattca

SEQ ID NO: 729438 - DNA, 13 bp, C. elegans
tgaatttactaaa

SEQ ID NO: 729439 - DNA, 13 bp, C. elegans
tgaatttatcaat

SEQ ID NO: 729440 - DNA, 13 bp, C. elegans
tgaatttatcgaa

SEQ ID NO: 729441 - DNA, 13 bp, C. elegans
tgaatttatgatt

SEQ ID NO: 729442 - DNA, 13 bp, C. elegans
tgaatttattgaa

SEQ ID NO: 729443 - DNA, 13 bp, C. elegans
tgaatttattgat

SEQ ID NO: 729444 - DNA, 13 bp, C. elegans
tgaatttatttca

SEQ ID NO: 729445 - DNA, 13 bp, C. elegans
tgaatttatttga

SEQ ID NO: 729446 - DNA, 13 bp, C. elegans
tgaatttcaaaat

SEQ ID NO: 729447 - DNA, 13 bp, C. elegans
tgaatttcaagaa

SEQ ID NO: 729448 - DNA, 13 bp, C. elegans
tgaatttcaataa

SEQ ID NO: 729449 - DNA, 13 bp, C. elegans
tgaatttcaattc

SEQ ID NO: 729450 - DNA, 13 bp, C. elegans
tgaatttcacaaa

SEQ ID NO: 729451 - DNA, 13 bp, C. elegans
tgaatttcagttt

SEQ ID NO: 729452 - DNA, 13 bp, C. elegans
tgaatttcataac

SEQ ID NO: 729453 - DNA, 13 bp, C. elegans
tgaatttcattaa

SEQ ID NO: 729454 - DNA, 13 bp, C. elegans
tgaatttccacaa

SEQ ID NO: 729455 - DNA, 13 bp, C. elegans
tgaatttcctgct

SEQ ID NO: 729456 - DNA, 13 bp, C. elegans
tgaatttcctttt

SEQ ID NO: 729457 - DNA, 13 bp, C. elegans
tgaatttcgaaaa

SEQ ID NO: 729458 - DNA, 13 bp, C. elegans
tgaatttctaaaa

SEQ ID NO: 729459 - DNA, 13 bp, C. elegans
tgaatttctaaat

SEQ ID NO: 729460 - DNA, 13 bp, C. elegans
tgaatttctaatt

SEQ ID NO: 729461 - DNA, 13 bp, C. elegans
tgaatttctcaaa

SEQ ID NO: 729462 - DNA, 13 bp, C. elegans
tgaatttctgaat

SEQ ID NO: 729463 - DNA, 13 bp, C. elegans
tgaatttcttatt

SEQ ID NO: 729464 - DNA, 13 bp, C. elegans
tgaatttcttttc

SEQ ID NO: 729465 - DNA, 13 bp, C. elegans
tgaatttgaaata

SEQ ID NO: 729466 - DNA, 13 bp, C. elegans
tgaatttgaaatt

SEQ ID NO: 729467 - DNA, 13 bp, C. elegans
tgaatttgaatat

SEQ ID NO: 729468 - DNA, 13 bp, C. elegans
tgaatttgaattg

SEQ ID NO: 729469 - DNA, 13 bp, C. elegans
tgaatttgagaaa

SEQ ID NO: 729470 - DNA, 13 bp, C. elegans
tgaatttgcaaaa

SEQ ID NO: 729471 - DNA, 13 bp, C. elegans
tgaatttggaaaa

SEQ ID NO: 729472 - DNA, 13 bp, C. elegans
tgaatttggaatt

SEQ ID NO: 729473 - DNA, 13 bp, C. elegans
tgaatttgtatta

SEQ ID NO: 729474 - DNA, 13 bp, C. elegans
tgaatttgtcatt

SEQ ID NO: 729475 - DNA, 13 bp, C. elegans
tgaatttgttaaa

SEQ ID NO: 729476 - DNA, 13 bp, C. elegans
tgaattttaatct

SEQ ID NO: 729477 - DNA, 13 bp, C. elegans
tgaattttactaa

SEQ ID NO: 729478 - DNA, 13 bp, C. elegans
tgaattttatatc

SEQ ID NO: 729479 - DNA, 13 bp, C. elegans
tgaattttcaaaa

SEQ ID NO: 729480 - DNA, 13 bp, C. elegans
tgaattttcataa

SEQ ID NO: 729481 - DNA, 13 bp, C. elegans
tgaattttccact

SEQ ID NO: 729482 - DNA, 13 bp, C. elegans
tgaattttccagt

SEQ ID NO: 729483 - DNA, 13 bp, C. elegans
tgaattttccata

SEQ ID NO: 729484 - DNA, 13 bp, C. elegans
tgaattttccgcc

SEQ ID NO: 729485 - DNA, 13 bp, C. elegans
tgaattttcgaaa

SEQ ID NO: 729486 - DNA, 13 bp, C. elegans
tgaattttcgcat

SEQ ID NO: 729487 - DNA, 13 bp, C. elegans
tgaattttctcaa

SEQ ID NO: 729488 - DNA, 13 bp, C. elegans
tgaattttctgct

SEQ ID NO: 729489 - DNA, 13 bp, C. elegans
tgaattttcttca

SEQ ID NO: 729490 - DNA, 13 bp, C. elegans
tgaattttgaaaa

SEQ ID NO: 729491 - DNA, 13 bp, C. elegans
tgaattttgacat

SEQ ID NO: 729492 - DNA, 13 bp, C. elegans
tgaattttgcaat

SEQ ID NO: 729493 - DNA, 13 bp, C. elegans
tgaatttttaagt

SEQ ID NO: 729494 - DNA, 13 bp, C. elegans
tgaatttttacat

SEQ ID NO: 729495 - DNA, 13 bp, C. elegans
tgaatttttatag

SEQ ID NO: 729496 - DNA, 13 bp, C. elegans
tgaatttttcaaa

SEQ ID NO: 729497 - DNA, 13 bp, C. elegans
tgaatttttcgaa

SEQ ID NO: 729498 - DNA, 13 bp, C. elegans
tgaatttttgcat

SEQ ID NO: 729499 - DNA, 13 bp, C. elegans
tgaatttttgtga

SEQ ID NO: 729500 - DNA, 13 bp, C. elegans
tgaattttttcga

SEQ ID NO: 729501 - DNA, 13 bp, C. elegans
tgaattttttgag

SEQ ID NO: 729502 - DNA, 13 bp, C. elegans
tgaattttttgga

SEQ ID NO: 729503 - DNA, 13 bp, C. elegans
tgaattttttggg

SEQ ID NO: 729504 - DNA, 13 bp, C. elegans
tgaatttttttcc

SEQ ID NO: 729505 - DNA, 13 bp, C. elegans
tgacaaaaacggg

SEQ ID NO: 729506 - DNA, 13 bp, C. elegans
tgacaaaaactat

SEQ ID NO: 729507 - DNA, 13 bp, C. elegans
tgacaaaatgttc

SEQ ID NO: 729508 - DNA, 13 bp, C. elegans
tgacaaaatgttt

SEQ ID NO: 729509 - DNA, 13 bp, C. elegans
tgacaaaattaaa

SEQ ID NO: 729510 - DNA, 13 bp, C. elegans
tgacaaaatttaa

SEQ ID NO: 729511 - DNA, 13 bp, C. elegans
tgacaaacttcag

SEQ ID NO: 729512 - DNA, 13 bp, C. elegans
tgacaaagaaaag

SEQ ID NO: 729513 - DNA, 13 bp, C. elegans
tgacaaagaaatt

SEQ ID NO: 729514 - DNA, 13 bp, C. elegans
tgacaaatcggca

SEQ ID NO: 729515 - DNA, 13 bp, C. elegans
tgacaaattgaaa

SEQ ID NO: 729516 - DNA, 13 bp, C. elegans
tgacaaattgatt

SEQ ID NO: 729517 - DNA, 13 bp, C. elegans
tgacaaatttccg

SEQ ID NO: 729518 - DNA, 13 bp, C. elegans
tgacaacaaaatt

SEQ ID NO: 729519 - DNA, 13 bp, C. elegans
tgacaacactttt

SEQ ID NO: 729520 - DNA, 13 bp, C. elegans
tgacaacattttg

SEQ ID NO: 729521 - DNA, 14 bp, C. elegans
tgacaactgatgat

SEQ ID NO: 729522 - DNA, 13 bp, C. elegans
tgacaactttctg

SEQ ID NO: 729523 - DNA, 13 bp, C. elegans
tgacaacttttac

SEQ ID NO: 729524 - DNA, 13 bp, C. elegans
tgacaactttttg

SEQ ID NO: 729525 - DNA, 13 bp, C. elegans
tgacaactttttt

SEQ ID NO: 729526 - DNA, 13 bp, C. elegans
tgacaagaaatac

SEQ ID NO: 729527 - DNA, 13 bp, C. elegans
tgacaagtcaaat

SEQ ID NO: 729528 - DNA, 13 bp, C. elegans
tgacaagtcggtc

SEQ ID NO: 729529 - DNA, 13 bp, C. elegans
tgacaagtttttg

SEQ ID NO: 729530 - DNA, 13 bp, C. elegans
tgacaatacaatt

SEQ ID NO: 729531 - DNA, 13 bp, C. elegans
tgacaatatatta

SEQ ID NO: 729532 - DNA, 13 bp, C. elegans
tgacaatttcaaa

SEQ ID NO: 729533 - DNA, 13 bp, C. elegans
tgacaatttgttt

SEQ ID NO: 729534 - DNA, 13 bp, C. elegans
tgacaattttatt

SEQ ID NO: 729535 - DNA, 13 bp, C. elegans
tgacacaaaattg

SEQ ID NO: 729536 - DNA, 13 bp, C. elegans
tgacacacacaca

SEQ ID NO: 729537 - DNA, 13 bp, C. elegans
tgacacagctgaa

SEQ ID NO: 729538 - DNA, 13 bp, C. elegans
tgacaccacgtgc

SEQ ID NO: 729539 - DNA, 13 bp, C. elegans
tgacacccatatc

SEQ ID NO: 729540 - DNA, 13 bp, C. elegans
tgacacccatatt

SEQ ID NO: 729541 - DNA, 13 bp, C. elegans
tgacactgaaaaa

SEQ ID NO: 729542 - DNA, 13 bp, C. elegans
tgacactttctcc

SEQ ID NO: 729543 - DNA, 13 bp, C. elegans
tgacactttttaa

SEQ ID NO: 729544 - DNA, 13 bp, C. elegans
tgacagaaatacc

SEQ ID NO: 729545 - DNA, 13 bp, C. elegans
tgacagaacaaaa

SEQ ID NO: 729546 - DNA, 13 bp, C. elegans
tgacagtgaataa

SEQ ID NO: 729547 - DNA, 13 bp, C. elegans
tgacagttcaaaa

SEQ ID NO: 729548 - DNA, 13 bp, C. elegans
tgacagttttaat

SEQ ID NO: 729549 - DNA, 13 bp, C. elegans
tgacatcactttt

SEQ ID NO: 729550 - DNA, 13 bp, C. elegans
tgacatcagcacg

SEQ ID NO: 729551 - DNA, 13 bp, C. elegans
tgacatcattttg

SEQ ID NO: 729552 - DNA, 13 bp, C. elegans
tgacattaaaaaa

SEQ ID NO: 729553 - DNA, 13 bp, C. elegans
tgacattattttt

SEQ ID NO: 729554 - DNA, 13 bp, C. elegans
tgacattgaggat

SEQ ID NO: 729555 - DNA, 13 bp, C. elegans
tgacattgatatc

SEQ ID NO: 729556 - DNA, 13 bp, C. elegans
tgacatttttcat

SEQ ID NO: 729557 - DNA, 13 bp, C. elegans
tgaccaaaatgat

SEQ ID NO: 729558 - DNA, 13 bp, C. elegans
tgacccccatcat

SEQ ID NO: 729559 - DNA, 13 bp, C. elegans
tgacccgagtgag

SEQ ID NO: 729560 - DNA, 13 bp, C. elegans
tgaccgaaatttt

SEQ ID NO: 729561 - DNA, 13 bp, C. elegans
tgacctaaaaatt

SEQ ID NO: 729562 - DNA, 13 bp, C. elegans
tgacctatttttt

SEQ ID NO: 729563 - DNA, 13 bp, C. elegans
tgaccttttttgt

SEQ ID NO: 729564 - DNA, 13 bp, C. elegans
tgacgacgacgac

SEQ ID NO: 729565 - DNA, 13 bp, C. elegans
tgacgattcgaga

SEQ ID NO: 729566 - DNA, 13 bp, C. elegans
tgacgatttttat

SEQ ID NO: 729567 - DNA, 13 bp, C. elegans
tgacgattttttt

SEQ ID NO: 729568 - DNA, 13 bp, C. elegans
tgacgggaaattc

SEQ ID NO: 729569 - DNA, 13 bp, C. elegans
tgacgtcacaatt

SEQ ID NO: 729570 - DNA, 13 bp, C. elegans
tgacgtcacagtt

SEQ ID NO: 729571 - DNA, 13 bp, C. elegans
tgacgtcactcct

SEQ ID NO: 729572 - DNA, 13 bp, C. elegans
tgacgtcactttt

SEQ ID NO: 729573 - DNA, 13 bp, C. elegans
tgacgtcataaat

SEQ ID NO: 729574 - DNA, 13 bp, C. elegans
tgacgtcatagct

SEQ ID NO: 729575 - DNA, 14 bp, C. elegans
tgacgtcatcacaa

SEQ ID NO: 729576 - DNA, 13 bp, C. elegans
tgacgtcatcacg

SEQ ID NO: 729577 - DNA, 13 bp, C. elegans
tgacgtcatcttt

SEQ ID NO: 729578 - DNA, 13 bp, C. elegans
tgacgtcattatt

SEQ ID NO: 729579 - DNA, 13 bp, C. elegans
tgacgtcatttct

SEQ ID NO: 729580 - DNA, 13 bp, C. elegans
tgacgtcattttt

SEQ ID NO: 729581 - DNA, 13 bp, C. elegans
tgacgtggcaaaa

SEQ ID NO: 729582 - DNA, 13 bp, C. elegans
tgactaaaaattt

SEQ ID NO: 729583 - DNA, 13 bp, C. elegans
tgactacaaacta

SEQ ID NO: 729584 - DNA, 13 bp, C. elegans
tgactacgaaaaa

SEQ ID NO: 729585 - DNA, 13 bp, C. elegans
tgactacggtaga

SEQ ID NO: 729586 - DNA, 13 bp, C. elegans
tgactactgtaac

SEQ ID NO: 729587 - DNA, 13 bp, C. elegans
tgactactttttt

SEQ ID NO: 729588 - DNA, 13 bp, C. elegans
tgactagaaattt

SEQ ID NO: 729589 - DNA, 13 bp, C. elegans
tgactagcgggcc

SEQ ID NO: 729590 - DNA, 13 bp, C. elegans
tgactatgctgaa

SEQ ID NO: 729591 - DNA, 13 bp, C. elegans
tgactattttgaa

SEQ ID NO: 729592 - DNA, 13 bp, C. elegans
tgactatttttat

SEQ ID NO: 729593 - DNA, 13 bp, C. elegans
tgactccgccccc

SEQ ID NO: 729594 - DNA, 13 bp, C. elegans
tgactcgaaataa

SEQ ID NO: 729595 - DNA, 13 bp, C. elegans
tgactgaaaaata

SEQ ID NO: 729596 - DNA, 13 bp, C. elegans
tgactgaaaatcg

SEQ ID NO: 729597 - DNA, 13 bp, C. elegans
tgactgaaaattg

SEQ ID NO: 729598 - DNA, 13 bp, C. elegans
tgactgaaaattt

SEQ ID NO: 729599 - DNA, 13 bp, C. elegans
tgactgaaattgt

SEQ ID NO: 729600 - DNA, 13 bp, C. elegans
tgactgtaatttt

SEQ ID NO: 729601 - DNA, 13 bp, C. elegans
tgacttaaaattt

SEQ ID NO: 729602 - DNA, 13 bp, C. elegans
tgacttcattttt

SEQ ID NO: 729603 - DNA, 13 bp, C. elegans
tgacttgaatttc

SEQ ID NO: 729604 - DNA, 13 bp, C. elegans
tgactttattttc

SEQ ID NO: 729605 - DNA, 13 bp, C. elegans
tgactttcaaaaa

SEQ ID NO: 729606 - DNA, 13 bp, C. elegans
tgactttgaaaaa

SEQ ID NO: 729607 - DNA, 13 bp, C. elegans
tgacttttcaaaa

SEQ ID NO: 729608 - DNA, 13 bp, C. elegans
tgacttttcgtct

SEQ ID NO: 729609 - DNA, 13 bp, C. elegans
tgacttttgaaaa

SEQ ID NO: 729610 - DNA, 13 bp, C. elegans
tgactttttaata

SEQ ID NO: 729611 - DNA, 13 bp, C. elegans
tgactttttctct

SEQ ID NO: 729612 - DNA, 13 bp, C. elegans
tgacttttttcta

SEQ ID NO: 729613 - DNA, 13 bp, C. elegans
tgagaaaaaccga

SEQ ID NO: 729614 - DNA, 13 bp, C. elegans
tgagaaaaacgag

SEQ ID NO: 729615 - DNA, 13 bp, C. elegans
tgagaaaaatagt

SEQ ID NO: 729616 - DNA, 13 bp, C. elegans
tgagaaaaatttt

SEQ ID NO: 729617 - DNA, 13 bp, C. elegans
tgagaaaacattt

SEQ ID NO: 729618 - DNA, 13 bp, C. elegans
tgagaaaacggaa

SEQ ID NO: 729619 - DNA, 13 bp, C. elegans
tgagaaaactgat

SEQ ID NO: 729620 - DNA, 13 bp, C. elegans
tgagaaaagtgat

SEQ ID NO: 729621 - DNA, 13 bp, C. elegans
tgagaaaatcgat

SEQ ID NO: 729622 - DNA, 13 bp, C. elegans
tgagaaaatgtgt

SEQ ID NO: 729623 - DNA, 13 bp, C. elegans
tgagaaaattgca

SEQ ID NO: 729624 - DNA, 13 bp, C. elegans
tgagaaaatttga

SEQ ID NO: 729625 - DNA, 13 bp, C. elegans
tgagaaacaagaa

SEQ ID NO: 729626 - DNA, 13 bp, C. elegans
tgagaaactaaaa

SEQ ID NO: 729627 - DNA, 13 bp, C. elegans
tgagaaactgaaa

SEQ ID NO: 729628 - DNA, 13 bp, C. elegans
tgagaaactggaa

SEQ ID NO: 729629 - DNA, 13 bp, C. elegans
tgagaaacttgaa

SEQ ID NO: 729630 - DNA, 13 bp, C. elegans
tgagaaataatga

SEQ ID NO: 729631 - DNA, 13 bp, C. elegans
tgagaaatcaaaa

SEQ ID NO: 729632 - DNA, 13 bp, C. elegans
tgagaaatcattt

SEQ ID NO: 729633 - DNA, 13 bp, C. elegans
tgagaaatgaaga

SEQ ID NO: 729634 - DNA, 13 bp, C. elegans
tgagaaatgagaa

SEQ ID NO: 729635 - DNA, 13 bp, C. elegans
tgagaaattaaat

SEQ ID NO: 729636 - DNA, 13 bp, C. elegans
tgagaaattattt

SEQ ID NO: 729637 - DNA, 13 bp, C. elegans
tgagaaattcaaa

SEQ ID NO: 729638 - DNA, 13 bp, C. elegans
tgagaaattcgga

SEQ ID NO: 729639 - DNA, 13 bp, C. elegans
tgagaaatttgaa

SEQ ID NO: 729640 - DNA, 13 bp, C. elegans
tgagaaatttttt

SEQ ID NO: 729641 - DNA, 13 bp, C. elegans
tgagaacattaaa

SEQ ID NO: 729642 - DNA, 13 bp, C. elegans
tgagaacattttt

SEQ ID NO: 729643 - DNA, 13 bp, C. elegans
tgagaacgttttt

SEQ ID NO: 729644 - DNA, 13 bp, C. elegans
tgagaactctgcc

SEQ ID NO: 729645 - DNA, 13 bp, C. elegans
tgagaacttttga

SEQ ID NO: 729646 - DNA, 13 bp, C. elegans
tgagaagaaagtg

SEQ ID NO: 729647 - DNA, 13 bp, C. elegans
tgagaagaagttg

SEQ ID NO: 729648 - DNA, 13 bp, C. elegans
tgagaagagaaat

SEQ ID NO: 729649 - DNA, 13 bp, C. elegans
tgagaagatttca

SEQ ID NO: 729650 - DNA, 13 bp, C. elegans
tgagaagtttcat

SEQ ID NO: 729651 - DNA, 13 bp, C. elegans
tgagaataatttg

SEQ ID NO: 729652 - DNA, 13 bp, C. elegans
tgagaatagccaa

SEQ ID NO: 729653 - DNA, 13 bp, C. elegans
tgagaatagtttt

SEQ ID NO: 729654 - DNA, 13 bp, C. elegans
tgagaatatcaaa

SEQ ID NO: 729655 - DNA, 13 bp, C. elegans
tgagaatatgaaa

SEQ ID NO: 729656 - DNA, 13 bp, C. elegans
tgagaatcaaaat

SEQ ID NO: 729657 - DNA, 13 bp, C. elegans
tgagaatgaaaat

SEQ ID NO: 729658 - DNA, 13 bp, C. elegans
tgagaatgcatat

SEQ ID NO: 729659 - DNA, 13 bp, C. elegans
tgagaatgtgaaa

SEQ ID NO: 729660 - DNA, 13 bp, C. elegans
tgagaattattga

SEQ ID NO: 729661 - DNA, 13 bp, C. elegans
tgagaattcaaat

SEQ ID NO: 729662 - DNA, 13 bp, C. elegans
tgagaattcagaa

SEQ ID NO: 729663 - DNA, 13 bp, C. elegans
tgagaattgagaa

SEQ ID NO: 729664 - DNA, 13 bp, C. elegans
tgagaattgattt

SEQ ID NO: 729665 - DNA, 13 bp, C. elegans
tgagaatttgaaa

SEQ ID NO: 729666 - DNA, 13 bp, C. elegans
tgagaatttggaa

SEQ ID NO: 729667 - DNA, 13 bp, C. elegans
tgagaattttatg

SEQ ID NO: 729668 - DNA, 13 bp, C. elegans
tgagaattttcga

SEQ ID NO: 729669 - DNA, 13 bp, C. elegans
tgagaattttttg

SEQ ID NO: 729670 - DNA, 13 bp, C. elegans
tgagacagaaaaa

SEQ ID NO: 729671 - DNA, 13 bp, C. elegans
tgagacagttttt

SEQ ID NO: 729672 - DNA, 13 bp, C. elegans
tgagacgcagaca

SEQ ID NO: 729673 - DNA, 13 bp, C. elegans
tgagacttttcaa

SEQ ID NO: 729674 - DNA, 13 bp, C. elegans
tgagagatttaga

SEQ ID NO: 729675 - DNA, 13 bp, C. elegans
tgagagattttga

SEQ ID NO: 729676 - DNA, 13 bp, C. elegans
tgagagttaatga

SEQ ID NO: 729677 - DNA, 13 bp, C. elegans
tgagagtttgaag

SEQ ID NO: 729678 - DNA, 13 bp, C. elegans
tgagatatcataa

SEQ ID NO: 729679 - DNA, 13 bp, C. elegans
tgagatgaagaaa

SEQ ID NO: 729680 - DNA, 13 bp, C. elegans
tgagattctgaaa

SEQ ID NO: 729681 - DNA, 13 bp, C. elegans
tgagattgaaaat

SEQ ID NO: 729682 - DNA, 13 bp, C. elegans
tgagatttctagg

SEQ ID NO: 729683 - DNA, 13 bp, C. elegans
tgagattttattg

SEQ ID NO: 729684 - DNA, 13 bp, C. elegans
tgagattttcaat

SEQ ID NO: 729685 - DNA, 13 bp, C. elegans
tgagattttcagt

SEQ ID NO: 729686 - DNA, 13 bp, C. elegans
tgagattttcgaa

SEQ ID NO: 729687 - DNA, 13 bp, C. elegans
tgagattttgcaa

SEQ ID NO: 729688 - DNA, 13 bp, C. elegans
tgagattttgtga

SEQ ID NO: 729689 - DNA, 13 bp, C. elegans
tgagatttttctt

SEQ ID NO: 729690 - DNA, 13 bp, C. elegans
tgagatttttgga

SEQ ID NO: 729691 - DNA, 13 bp, C. elegans
tgagattttttga

SEQ ID NO: 729692 - DNA, 13 bp, C. elegans
tgagatttttttc

SEQ ID NO: 729693 - DNA, 13 bp, C. elegans
tgagcaaaaaata

SEQ ID NO: 729694 - DNA, 13 bp, C. elegans
tgagcaaaaaatt

SEQ ID NO: 729695 - DNA, 13 bp, C. elegans
tgagcaaaaacta

SEQ ID NO: 729696 - DNA, 13 bp, C. elegans
tgagcaaaaagag

SEQ ID NO: 729697 - DNA, 13 bp, C. elegans
tgagcaaaaagtg

SEQ ID NO: 729698 - DNA, 13 bp, C. elegans
tgagcaaagaaat

SEQ ID NO: 729699 - DNA, 13 bp, C. elegans
tgagcaagaaaaa

SEQ ID NO: 729700 - DNA, 13 bp, C. elegans
tgagcaattcaat

SEQ ID NO: 729701 - DNA, 13 bp, C. elegans
tgagcaattggat

SEQ ID NO: 729702 - DNA, 13 bp, C. elegans
tgagcaatttgtt

SEQ ID NO: 729703 - DNA, 13 bp, C. elegans
tgagcacaaaaaa

SEQ ID NO: 729704 - DNA, 13 bp, C. elegans
tgagcacaaattt

SEQ ID NO: 729705 - DNA, 13 bp, C. elegans
tgagcacaatttt

SEQ ID NO: 729706 - DNA, 13 bp, C. elegans
tgagcactttctc

SEQ ID NO: 729707 - DNA, 13 bp, C. elegans
tgagcatggacca

SEQ ID NO: 729708 - DNA, 13 bp, C. elegans
tgagcattttgaa

SEQ ID NO: 729709 - DNA, 13 bp, C. elegans
tgagcatttttaa

SEQ ID NO: 729710 - DNA, 13 bp, C. elegans
tgagccaaaaatc

SEQ ID NO: 729711 - DNA, 13 bp, C. elegans
tgagccaaaactc

SEQ ID NO: 729712 - DNA, 13 bp, C. elegans
tgagccaaaagtg

SEQ ID NO: 729713 - DNA, 13 bp, C. elegans
tgagccaaaattg

SEQ ID NO: 729714 - DNA, 13 bp, C. elegans
tgagccaaatttt

SEQ ID NO: 729715 - DNA, 13 bp, C. elegans
tgagctcaaataa

SEQ ID NO: 729716 - DNA, 13 bp, C. elegans
tgagctcactttt

SEQ ID NO: 729717 - DNA, 13 bp, C. elegans
tgagctgaaaatt

SEQ ID NO: 729718 - DNA, 13 bp, C. elegans
tgagcttaaaatt

SEQ ID NO: 729719 - DNA, 13 bp, C. elegans
tgagcttctgtga

SEQ ID NO: 729720 - DNA, 14 bp, C. elegans
tgagcttctgtgat

SEQ ID NO: 729721 - DNA, 13 bp, C. elegans
tgagcttcttctc

SEQ ID NO: 729722 - DNA, 13 bp, C. elegans
tgagcttttcaga

SEQ ID NO: 729723 - DNA, 13 bp, C. elegans
tgagcttttcgcg

SEQ ID NO: 729724 - DNA, 13 bp, C. elegans
tgagctttttgag

SEQ ID NO: 729725 - DNA, 13 bp, C. elegans
tgaggaaaaagtt

SEQ ID NO: 729726 - DNA, 13 bp, C. elegans
tgaggaaatttga

SEQ ID NO: 729727 - DNA, 13 bp, C. elegans
tgaggaacaaaaa

SEQ ID NO: 729728 - DNA, 13 bp, C. elegans
tgaggaggattta

SEQ ID NO: 729729 - DNA, 13 bp, C. elegans
tgaggattttgag

SEQ ID NO: 729730 - DNA, 13 bp, C. elegans
tgaggctacagta

SEQ ID NO: 729731 - DNA, 13 bp, C. elegans
tgaggctgaagag

SEQ ID NO: 729732 - DNA, 13 bp, C. elegans
tgaggtaaatttt

SEQ ID NO: 729733 - DNA, 13 bp, C. elegans
tgagtactgtaat

SEQ ID NO: 729734 - DNA, 13 bp, C. elegans
tgagtgaaaaatt

SEQ ID NO: 729735 - DNA, 13 bp, C. elegans
tgagttattcatt

SEQ ID NO: 729736 - DNA, 13 bp, C. elegans
tgagttcaaaaaa

SEQ ID NO: 729737 - DNA, 13 bp, C. elegans
tgagttctttttc

SEQ ID NO: 729738 - DNA, 13 bp, C. elegans
tgagttgaaaaat

SEQ ID NO: 729739 - DNA, 13 bp, C. elegans
tgagtttatttca

SEQ ID NO: 729740 - DNA, 13 bp, C. elegans
tgagtttcaaaaa

SEQ ID NO: 729741 - DNA, 13 bp, C. elegans
tgagtttcatttt

SEQ ID NO: 729742 - DNA, 13 bp, C. elegans
tgagtttgaaaat

SEQ ID NO: 729743 - DNA, 13 bp, C. elegans
tgagtttgaaatt

SEQ ID NO: 729744 - DNA, 13 bp, C. elegans
tgagttttaaaaa

SEQ ID NO: 729745 - DNA, 13 bp, C. elegans
tgagttttcagat

SEQ ID NO: 729746 - DNA, 13 bp, C. elegans
tgagttttgaaat

SEQ ID NO: 729747 - DNA, 13 bp, C. elegans
tgagtttttagaa

SEQ ID NO: 729748 - DNA, 13 bp, C. elegans
tgagtttttgaaa

SEQ ID NO: 729749 - DNA, 13 bp, C. elegans
tgagttttttcta

SEQ ID NO: 729750 - DNA, 13 bp, C. elegans
tgataaaaaacat

SEQ ID NO: 729751 - DNA, 13 bp, C. elegans
tgataaaaaactt

SEQ ID NO: 729752 - DNA, 13 bp, C. elegans
tgataaaaaagtt

SEQ ID NO: 729753 - DNA, 13 bp, C. elegans
tgataaaaatgga

SEQ ID NO: 729754 - DNA, 13 bp, C. elegans
tgataaaaatgta

SEQ ID NO: 729755 - DNA, 13 bp, C. elegans
tgataaaaattga

SEQ ID NO: 729756 - DNA, 13 bp, C. elegans
tgataaaagtttt

SEQ ID NO: 729757 - DNA, 13 bp, C. elegans
tgataaaattgtt

SEQ ID NO: 729758 - DNA, 13 bp, C. elegans
tgataaaatttca

SEQ ID NO: 729759 - DNA, 13 bp, C. elegans
tgataaacaaata

SEQ ID NO: 729760 - DNA, 13 bp, C. elegans
tgataaagttgaa

SEQ ID NO: 729761 - DNA, 13 bp, C. elegans
tgataaatatgaa

SEQ ID NO: 729762 - DNA, 13 bp, C. elegans
tgataaatcaatt

SEQ ID NO: 729763 - DNA, 13 bp, C. elegans
tgataaatcagaa

SEQ ID NO: 729764 - DNA, 13 bp, C. elegans
tgataaatctgaa

SEQ ID NO: 729765 - DNA, 13 bp, C. elegans
tgataaatgataa

SEQ ID NO: 729766 - DNA, 13 bp, C. elegans
tgataaattcatt

SEQ ID NO: 729767 - DNA, 13 bp, C. elegans
tgataaatttgtt

SEQ ID NO: 729768 - DNA, 13 bp, C. elegans
tgataaatttttg

SEQ ID NO: 729769 - DNA, 13 bp, C. elegans
tgataacaaaact

SEQ ID NO: 729770 - DNA, 13 bp, C. elegans
tgataacaaaata

SEQ ID NO: 729771 - DNA, 13 bp, C. elegans
tgataacaatatt

SEQ ID NO: 729772 - DNA, 13 bp, C. elegans
tgataacacagaa

SEQ ID NO: 729773 - DNA, 13 bp, C. elegans
tgataacataatt

SEQ ID NO: 729774 - DNA, 13 bp, C. elegans
tgataacatatga

SEQ ID NO: 729775 - DNA, 13 bp, C. elegans
tgataacattttc

SEQ ID NO: 729776 - DNA, 13 bp, C. elegans
tgataactgataa

SEQ ID NO: 729777 - DNA, 13 bp, C. elegans
tgataactttttg

SEQ ID NO: 729778 - DNA, 13 bp, C. elegans
tgataactttttt

SEQ ID NO: 729779 - DNA, 13 bp, C. elegans
tgataagaaaact

SEQ ID NO: 729780 - DNA, 13 bp, C. elegans
tgataagaaagtt

SEQ ID NO: 729781 - DNA, 13 bp, C. elegans
tgataagaagttg

SEQ ID NO: 729782 - DNA, 13 bp, C. elegans
tgataagaatgat

SEQ ID NO: 729783 - DNA, 13 bp, C. elegans
tgataagataaga

SEQ ID NO: 729784 - DNA, 13 bp, C. elegans
tgataatattttg

SEQ ID NO: 729785 - DNA, 13 bp, C. elegans
tgataatcaaata

SEQ ID NO: 729786 - DNA, 13 bp, C. elegans
tgataatcaaatt

SEQ ID NO: 729787 - DNA, 13 bp, C. elegans
tgataatctgatt

SEQ ID NO: 729788 - DNA, 13 bp, C. elegans
tgataatgataat

SEQ ID NO: 729789 - DNA, 13 bp, C. elegans
tgataatgatgat

SEQ ID NO: 729790 - DNA, 13 bp, C. elegans
tgataattcaaaa

SEQ ID NO: 729791 - DNA, 13 bp, C. elegans
tgataattcaatt

SEQ ID NO: 729792 - DNA, 13 bp, C. elegans
tgataattccaaa

SEQ ID NO: 729793 - DNA, 13 bp, C. elegans
tgataattgaaaa

SEQ ID NO: 729794 - DNA, 13 bp, C. elegans
tgataattggaaa

SEQ ID NO: 729795 - DNA, 13 bp, C. elegans
tgataatttagaa

SEQ ID NO: 729796 - DNA, 13 bp, C. elegans
tgataatttattc

SEQ ID NO: 729797 - DNA, 13 bp, C. elegans
tgataatttctaa

SEQ ID NO: 729798 - DNA, 13 bp, C. elegans
tgataattttcac

SEQ ID NO: 729799 - DNA, 13 bp, C. elegans
tgataattttcag

SEQ ID NO: 729800 - DNA, 13 bp, C. elegans
tgataattttgaa

SEQ ID NO: 729801 - DNA, 13 bp, C. elegans
tgataattttgag

SEQ ID NO: 729802 - DNA, 13 bp, C. elegans
tgataatttttcc

SEQ ID NO: 729803 - DNA, 13 bp, C. elegans
tgatacaaaaatt

SEQ ID NO: 729804 - DNA, 13 bp, C. elegans
tgatacacaaaaa

SEQ ID NO: 729805 - DNA, 13 bp, C. elegans
tgatacatatgat

SEQ ID NO: 729806 - DNA, 14 bp, C. elegans
tgatacatatgctg

SEQ ID NO: 729807 - DNA, 13 bp, C. elegans
tgatacatttgaa

SEQ ID NO: 729808 - DNA, 13 bp, C. elegans
tgatacattttca

SEQ ID NO: 729809 - DNA, 13 bp, C. elegans
tgatacggagttt

SEQ ID NO: 729810 - DNA, 13 bp, C. elegans
tgatacgtttttt

SEQ ID NO: 729811 - DNA, 13 bp, C. elegans
tgatactgaaaaa

SEQ ID NO: 729812 - DNA, 13 bp, C. elegans
tgatagaattttt

SEQ ID NO: 729813 - DNA, 13 bp, C. elegans
tgatagaggaaat

SEQ ID NO: 729814 - DNA, 13 bp, C. elegans
tgatagatgaaaa

SEQ ID NO: 729815 - DNA, 13 bp, C. elegans
tgatagtagaaaa

SEQ ID NO: 729816 - DNA, 13 bp, C. elegans
tgatagtgaacaa

SEQ ID NO: 729817 - DNA, 13 bp, C. elegans
tgatagtttcaaa

SEQ ID NO: 729818 - DNA, 13 bp, C. elegans
tgatagttttgaa

SEQ ID NO: 729819 - DNA, 13 bp, C. elegans
tgatatcgatttt

SEQ ID NO: 729820 - DNA, 13 bp, C. elegans
tgatatctcaaaa

SEQ ID NO: 729821 - DNA, 13 bp, C. elegans
tgatatctcttct

SEQ ID NO: 729822 - DNA, 13 bp, C. elegans
tgatatcttcaaa

SEQ ID NO: 729823 - DNA, 13 bp, C. elegans
tgatatgaataaa

SEQ ID NO: 729824 - DNA, 13 bp, C. elegans
tgatatgtacaaa

SEQ ID NO: 729825 - DNA, 13 bp, C. elegans
tgatattatcaaa

SEQ ID NO: 729826 - DNA, 13 bp, C. elegans
tgatattcaattt

SEQ ID NO: 729827 - DNA, 13 bp, C. elegans
tgatattctattt

SEQ ID NO: 729828 - DNA, 13 bp, C. elegans
tgatattctgtca

SEQ ID NO: 729829 - DNA, 13 bp, C. elegans
tgatattgaagaa

SEQ ID NO: 729830 - DNA, 13 bp, C. elegans
tgatattggttgg

SEQ ID NO: 729831 - DNA, 13 bp, C. elegans
tgatattgttggg

SEQ ID NO: 729832 - DNA, 13 bp, C. elegans
tgatatttcaagt

SEQ ID NO: 729833 - DNA, 13 bp, C. elegans
tgatatttccaaa

SEQ ID NO: 729834 - DNA, 13 bp, C. elegans
tgatatttcttca

SEQ ID NO: 729835 - DNA, 13 bp, C. elegans
tgatatttgatat

SEQ ID NO: 729836 - DNA, 13 bp, C. elegans
tgatatttgccat

SEQ ID NO: 729837 - DNA, 13 bp, C. elegans
tgatatttggaaa

SEQ ID NO: 729838 - DNA, 13 bp, C. elegans
tgatattttaaga

SEQ ID NO: 729839 - DNA, 13 bp, C. elegans
tgatattttcaaa

SEQ ID NO: 729840 - DNA, 13 bp, C. elegans
tgatattttgcaa

SEQ ID NO: 729841 - DNA, 13 bp, C. elegans
tgatcaaaaatca

SEQ ID NO: 729842 - DNA, 13 bp, C. elegans
tgatcaaaagttt

SEQ ID NO: 729843 - DNA, 13 bp, C. elegans
tgatcaaataaaa

SEQ ID NO: 729844 - DNA, 13 bp, C. elegans
tgatcaaattgaa

SEQ ID NO: 729845 - DNA, 13 bp, C. elegans
tgatcaacaacag

SEQ ID NO: 729846 - DNA, 13 bp, C. elegans
tgatcaactccaa

SEQ ID NO: 729847 - DNA, 13 bp, C. elegans
tgatcaattttca

SEQ ID NO: 729848 - DNA, 13 bp, C. elegans
tgatcacaaaatt

SEQ ID NO: 729849 - DNA, 13 bp, C. elegans
tgatcactgaaaa

SEQ ID NO: 729850 - DNA, 14 bp, C. elegans
tgatcagagcaacg

SEQ ID NO: 729851 - DNA, 13 bp, C. elegans
tgatcaggaaaaa

SEQ ID NO: 729852 - DNA, 13 bp, C. elegans
tgatcatcatcat

SEQ ID NO: 729853 - DNA, 13 bp, C. elegans
tgatcattcaaaa

SEQ ID NO: 729854 - DNA, 13 bp, C. elegans
tgatcatttgatt

SEQ ID NO: 729855 - DNA, 13 bp, C. elegans
tgatcattttgtt

SEQ ID NO: 729856 - DNA, 13 bp, C. elegans
tgatccaaaacga

SEQ ID NO: 729857 - DNA, 13 bp, C. elegans
tgatccatttttc

SEQ ID NO: 729858 - DNA, 13 bp, C. elegans
tgatcccactggg

SEQ ID NO: 729859 - DNA, 13 bp, C. elegans
tgatctaaatatt

SEQ ID NO: 729860 - DNA, 13 bp, C. elegans
tgatctacagaaa

SEQ ID NO: 729861 - DNA, 13 bp, C. elegans
tgatctacatttt

SEQ ID NO: 729862 - DNA, 13 bp, C. elegans
tgatctacctact

SEQ ID NO: 729863 - DNA, 13 bp, C. elegans
tgatctactgaaa

SEQ ID NO: 729864 - DNA, 13 bp, C. elegans
tgatctcatttcc

SEQ ID NO: 729865 - DNA, 13 bp, C. elegans
tgatctccaaaaa

SEQ ID NO: 729866 - DNA, 13 bp, C. elegans
tgatctgaaaatt

SEQ ID NO: 729867 - DNA, 13 bp, C. elegans
tgatctgatcctt

SEQ ID NO: 729868 - DNA, 13 bp, C. elegans
tgatcttaaaatt

SEQ ID NO: 729869 - DNA, 13 bp, C. elegans
tgatcttcaaaat

SEQ ID NO: 729870 - DNA, 13 bp, C. elegans
tgatcttcgagaa

SEQ ID NO: 729871 - DNA, 13 bp, C. elegans
tgatctttcattt

SEQ ID NO: 729872 - DNA, 13 bp, C. elegans
tgatcttttcaaa

SEQ ID NO: 729873 - DNA, 13 bp, C. elegans
tgatgaaaaactt

SEQ ID NO: 729874 - DNA, 13 bp, C. elegans
tgatgaaaaatgt

SEQ ID NO: 729875 - DNA, 13 bp, C. elegans
tgatgaaaacaaa

SEQ ID NO: 729876 - DNA, 13 bp, C. elegans
tgatgaaaatatg

SEQ ID NO: 729877 - DNA, 13 bp, C. elegans
tgatgaaacttct

SEQ ID NO: 729878 - DNA, 13 bp, C. elegans
tgatgaaagttta

SEQ ID NO: 729879 - DNA, 13 bp, C. elegans
tgatgaaattatt

SEQ ID NO: 729880 - DNA, 13 bp, C. elegans
tgatgaagatgat

SEQ ID NO: 729881 - DNA, 13 bp, C. elegans
tgatgaagtaaaa

SEQ ID NO: 729882 - DNA, 13 bp, C. elegans
tgatgaataaata

SEQ ID NO: 729883 - DNA, 13 bp, C. elegans
tgatgaattattt

SEQ ID NO: 729884 - DNA, 13 bp, C. elegans
tgatgaatttcca

SEQ ID NO: 729885 - DNA, 13 bp, C. elegans
tgatgacaattca

SEQ ID NO: 729886 - DNA, 13 bp, C. elegans
tgatgacgtcaca

SEQ ID NO: 729887 - DNA, 13 bp, C. elegans
tgatgacgtcata

SEQ ID NO: 729888 - DNA, 13 bp, C. elegans
tgatgacgtggca

SEQ ID NO: 729889 - DNA, 13 bp, C. elegans
tgatgataagaat

SEQ ID NO: 729890 - DNA, 13 bp, C. elegans
tgatgatattatg

SEQ ID NO: 729891 - DNA, 13 bp, C. elegans
tgatgatatttta

SEQ ID NO: 729892 - DNA, 13 bp, C. elegans
tgatgatctgatc

SEQ ID NO: 729893 - DNA, 13 bp, C. elegans
tgatgatgataaa

SEQ ID NO: 729894 - DNA, 13 bp, C. elegans
tgatgatgatgac

SEQ ID NO: 729895 - DNA, 13 bp, C. elegans
tgatgatgatgga

SEQ ID NO: 729896 - DNA, 13 bp, C. elegans
tgatgatgatggt

SEQ ID NO: 729897 - DNA, 13 bp, C. elegans
tgatgatgattac

SEQ ID NO: 729898 - DNA, 13 bp, C. elegans
tgatgatgttgat

SEQ ID NO: 729899 - DNA, 13 bp, C. elegans
tgatgattaaaaa

SEQ ID NO: 729900 - DNA, 13 bp, C. elegans
tgatgatttcaaa

SEQ ID NO: 729901 - DNA, 13 bp, C. elegans
tgatgatttcgat

SEQ ID NO: 729902 - DNA, 13 bp, C. elegans
tgatgattttcca

SEQ ID NO: 729903 - DNA, 13 bp, C. elegans
tgatgatttttgg

SEQ ID NO: 729904 - DNA, 13 bp, C. elegans
tgatgcaccatgt

SEQ ID NO: 729905 - DNA, 13 bp, C. elegans
tgatgctccaaaa

SEQ ID NO: 729906 - DNA, 13 bp, C. elegans
tgatgcttctcaa

SEQ ID NO: 729907 - DNA, 13 bp, C. elegans
tgatggaatcaat

SEQ ID NO: 729908 - DNA, 13 bp, C. elegans
tgatggataatgt

SEQ ID NO: 729909 - DNA, 13 bp, C. elegans
tgatggatctgga

SEQ ID NO: 729910 - DNA, 13 bp, C. elegans
tgatggccgagtt

SEQ ID NO: 729911 - DNA, 13 bp, C. elegans
tgatgtatttgtc

SEQ ID NO: 729912 - DNA, 13 bp, C. elegans
tgatgtcgattta

SEQ ID NO: 729913 - DNA, 13 bp, C. elegans
tgatgttcaaaat

SEQ ID NO: 729914 - DNA, 13 bp, C. elegans
tgatgttgaaaaa

SEQ ID NO: 729915 - DNA, 13 bp, C. elegans
tgatgtttcaatt

SEQ ID NO: 729916 - DNA, 13 bp, C. elegans
tgatgttttcgaa

SEQ ID NO: 729917 - DNA, 13 bp, C. elegans
tgatgtttttcaa

SEQ ID NO: 729918 - DNA, 13 bp, C. elegans
tgatgtttttcat

SEQ ID NO: 729919 - DNA, 13 bp, C. elegans
tgattaactacaa

SEQ ID NO: 729920 - DNA, 13 bp, C. elegans
tgattaagaacgt

SEQ ID NO: 729921 - DNA, 13 bp, C. elegans
tgattacaaaaat

SEQ ID NO: 729922 - DNA, 13 bp, C. elegans
tgattactgtagt

SEQ ID NO: 729923 - DNA, 13 bp, C. elegans
tgattagtttgaa

SEQ ID NO: 729924 - DNA, 13 bp, C. elegans
tgattatgaaaaa

SEQ ID NO: 729925 - DNA, 13 bp, C. elegans
tgattatgattat

SEQ ID NO: 729926 - DNA, 13 bp, C. elegans
tgattattcaaat

SEQ ID NO: 729927 - DNA, 13 bp, C. elegans
tgattattttcca

SEQ ID NO: 729928 - DNA, 13 bp, C. elegans
tgattattttcta

SEQ ID NO: 729929 - DNA, 13 bp, C. elegans
tgattcaaaacta

SEQ ID NO: 729930 - DNA, 13 bp, C. elegans
tgattcaaaagaa

SEQ ID NO: 729931 - DNA, 13 bp, C. elegans
tgattcaaaagtt

SEQ ID NO: 729932 - DNA, 13 bp, C. elegans
tgattcaaaatta

SEQ ID NO: 729933 - DNA, 13 bp, C. elegans
tgattcaaattta

SEQ ID NO: 729934 - DNA, 13 bp, C. elegans
tgattcaagtatt

SEQ ID NO: 729935 - DNA, 13 bp, C. elegans
tgattcatagttt

SEQ ID NO: 729936 - DNA, 13 bp, C. elegans
tgattcattcaac

SEQ ID NO: 729937 - DNA, 13 bp, C. elegans
tgattcattttat

SEQ ID NO: 729938 - DNA, 13 bp, C. elegans
tgattccaaaaac

SEQ ID NO: 729939 - DNA, 13 bp, C. elegans
tgattccaaattt

SEQ ID NO: 729940 - DNA, 13 bp, C. elegans
tgattccattgaa

SEQ ID NO: 729941 - DNA, 13 bp, C. elegans
tgattccattttt

SEQ ID NO: 729942 - DNA, 13 bp, C. elegans
tgattccgaatat

SEQ ID NO: 729943 - DNA, 13 bp, C. elegans
tgattcctcgaaa

SEQ ID NO: 729944 - DNA, 13 bp, C. elegans
tgattctcaaaaa

SEQ ID NO: 729945 - DNA, 13 bp, C. elegans
tgattctgatgcc

SEQ ID NO: 729946 - DNA, 13 bp, C. elegans
tgattctgtttct

SEQ ID NO: 729947 - DNA, 13 bp, C. elegans
tgattctttcacc

SEQ ID NO: 729948 - DNA, 13 bp, C. elegans
tgattgaaaatta

SEQ ID NO: 729949 - DNA, 13 bp, C. elegans
tgattgaaacatt

SEQ ID NO: 729950 - DNA, 13 bp, C. elegans
tgattgaaataat

SEQ ID NO: 729951 - DNA, 13 bp, C. elegans
tgattgaatatat

SEQ ID NO: 729952 - DNA, 13 bp, C. elegans
tgattgaatttca

SEQ ID NO: 729953 - DNA, 13 bp, C. elegans
tgattgattgaaa

SEQ ID NO: 729954 - DNA, 13 bp, C. elegans
tgattgatttctt

SEQ ID NO: 729955 - DNA, 13 bp, C. elegans
tgattgattttaa

SEQ ID NO: 729956 - DNA, 13 bp, C. elegans
tgattgcaatttt

SEQ ID NO: 729957 - DNA, 13 bp, C. elegans
tgattggccagct

SEQ ID NO: 729958 - DNA, 13 bp, C. elegans
tgattggttcaaa

SEQ ID NO: 729959 - DNA, 13 bp, C. elegans
tgattgtttaaaa

SEQ ID NO: 729960 - DNA, 13 bp, C. elegans
tgatttaaagatt

SEQ ID NO: 729961 - DNA, 13 bp, C. elegans
tgatttatcaaat

SEQ ID NO: 729962 - DNA, 13 bp, C. elegans
tgatttatgaaaa

SEQ ID NO: 729963 - DNA, 13 bp, C. elegans
tgatttattgaaa

SEQ ID NO: 729964 - DNA, 13 bp, C. elegans
tgatttatttaac

SEQ ID NO: 729965 - DNA, 13 bp, C. elegans
tgatttcaaaaaa

SEQ ID NO: 729966 - DNA, 13 bp, C. elegans
tgatttcaaaaat

SEQ ID NO: 729967 - DNA, 13 bp, C. elegans
tgatttcaaaata

SEQ ID NO: 729968 - DNA, 13 bp, C. elegans
tgatttcaaattt

SEQ ID NO: 729969 - DNA, 13 bp, C. elegans
tgatttcaatatt

SEQ ID NO: 729970 - DNA, 13 bp, C. elegans
tgatttcactttt

SEQ ID NO: 729971 - DNA, 13 bp, C. elegans
tgatttcagaaat

SEQ ID NO: 729972 - DNA, 13 bp, C. elegans
tgatttcattatt

SEQ ID NO: 729973 - DNA, 13 bp, C. elegans
tgatttcattcaa

SEQ ID NO: 729974 - DNA, 13 bp, C. elegans
tgatttccaaaaa

SEQ ID NO: 729975 - DNA, 13 bp, C. elegans
tgatttctaaact

SEQ ID NO: 729976 - DNA, 13 bp, C. elegans
tgatttctgaata

SEQ ID NO: 729977 - DNA, 13 bp, C. elegans
tgatttcttcaaa

SEQ ID NO: 729978 - DNA, 13 bp, C. elegans
tgatttcttgaaa

SEQ ID NO: 729979 - DNA, 13 bp, C. elegans
tgatttcttggct

SEQ ID NO: 729980 - DNA, 13 bp, C. elegans
tgatttcttttca

SEQ ID NO: 729981 - DNA, 13 bp, C. elegans
tgatttgaaaaag

SEQ ID NO: 729982 - DNA, 13 bp, C. elegans
tgatttgaaaaca

SEQ ID NO: 729983 - DNA, 13 bp, C. elegans
tgatttgaaaatt

SEQ ID NO: 729984 - DNA, 13 bp, C. elegans
tgatttgacggaa

SEQ ID NO: 729985 - DNA, 13 bp, C. elegans
tgatttgataaaa

SEQ ID NO: 729986 - DNA, 13 bp, C. elegans
tgatttgatcttc

SEQ ID NO: 729987 - DNA, 13 bp, C. elegans
tgatttgattagt

SEQ ID NO: 729988 - DNA, 13 bp, C. elegans
tgatttggaaaaa

SEQ ID NO: 729989 - DNA, 13 bp, C. elegans
tgatttggaaatt

SEQ ID NO: 729990 - DNA, 13 bp, C. elegans
tgatttgggaatt

SEQ ID NO: 729991 - DNA, 13 bp, C. elegans
tgatttgtttgaa

SEQ ID NO: 729992 - DNA, 13 bp, C. elegans
tgattttaaaatc

SEQ ID NO: 729993 - DNA, 13 bp, C. elegans
tgattttaaacac

SEQ ID NO: 729994 - DNA, 13 bp, C. elegans
tgattttaaatga

SEQ ID NO: 729995 - DNA, 13 bp, C. elegans
tgattttaatgaa

SEQ ID NO: 729996 - DNA, 13 bp, C. elegans
tgattttaattca

SEQ ID NO: 729997 - DNA, 13 bp, C. elegans
tgattttaatttc

SEQ ID NO: 729998 - DNA, 13 bp, C. elegans
tgattttacgttc

SEQ ID NO: 729999 - DNA, 13 bp, C. elegans
tgattttatatga

SEQ ID NO: 730000 - DNA, 13 bp, C. elegans
tgattttatcaaa

SEQ ID NO: 730001 - DNA, 13 bp, C. elegans
tgattttatgaaa

SEQ ID NO: 730002 - DNA, 13 bp, C. elegans
tgattttcaaatt

SEQ ID NO: 730003 - DNA, 14 bp, C. elegans
tgattttcaaattt

SEQ ID NO: 730004 - DNA, 13 bp, C. elegans
tgattttcacaga

SEQ ID NO: 730005 - DNA, 13 bp, C. elegans
tgattttcagaaa

SEQ ID NO: 730006 - DNA, 13 bp, C. elegans
tgattttcgatta

SEQ ID NO: 730007 - DNA, 13 bp, C. elegans
tgattttctaggc

SEQ ID NO: 730008 - DNA, 13 bp, C. elegans
tgattttctatca

SEQ ID NO: 730009 - DNA, 13 bp, C. elegans
tgattttctatga

SEQ ID NO: 730010 - DNA, 13 bp, C. elegans
tgattttctatta

SEQ ID NO: 730011 - DNA, 13 bp, C. elegans
tgattttctccat

SEQ ID NO: 730012 - DNA, 13 bp, C. elegans
tgattttctcgaa

SEQ ID NO: 730013 - DNA, 13 bp, C. elegans
tgattttgaaaaa

SEQ ID NO: 730014 - DNA, 13 bp, C. elegans
tgattttgaacat

SEQ ID NO: 730015 - DNA, 13 bp, C. elegans
tgattttgaataa

SEQ ID NO: 730016 - DNA, 13 bp, C. elegans
tgattttgaatca

SEQ ID NO: 730017 - DNA, 13 bp, C. elegans
tgattttgatcaa

SEQ ID NO: 730018 - DNA, 13 bp, C. elegans
tgattttgatgaa

SEQ ID NO: 730019 - DNA, 13 bp, C. elegans
tgattttgtatgg

SEQ ID NO: 730020 - DNA, 13 bp, C. elegans
tgattttgttcaa

SEQ ID NO: 730021 - DNA, 13 bp, C. elegans
tgatttttcaata

SEQ ID NO: 730022 - DNA, 13 bp, C. elegans
tgatttttcaatt

SEQ ID NO: 730023 - DNA, 13 bp, C. elegans
tgatttttcacat

SEQ ID NO: 730024 - DNA, 13 bp, C. elegans
tgatttttcagga

SEQ ID NO: 730025 - DNA, 13 bp, C. elegans
tgatttttcatga

SEQ ID NO: 730026 - DNA, 13 bp, C. elegans
tgatttttccaaa

SEQ ID NO: 730027 - DNA, 13 bp, C. elegans
tgatttttccatt

SEQ ID NO: 730028 - DNA, 13 bp, C. elegans
tgatttttcctta

SEQ ID NO: 730029 - DNA, 13 bp, C. elegans
tgatttttcgtgt

SEQ ID NO: 730030 - DNA, 13 bp, C. elegans
tgatttttctcaa

SEQ ID NO: 730031 - DNA, 13 bp, C. elegans
tgatttttctgaa

SEQ ID NO: 730032 - DNA, 13 bp, C. elegans
tgatttttctgga

SEQ ID NO: 730033 - DNA, 13 bp, C. elegans
tgatttttctgta

SEQ ID NO: 730034 - DNA, 13 bp, C. elegans
tgatttttcttca

SEQ ID NO: 730035 - DNA, 13 bp, C. elegans
tgatttttgaaaa

SEQ ID NO: 730036 - DNA, 13 bp, C. elegans
tgatttttgtctg

SEQ ID NO: 730037 - DNA, 13 bp, C. elegans
tgatttttgtgaa

SEQ ID NO: 730038 - DNA, 13 bp, C. elegans
tgattttttcaaa

SEQ ID NO: 730039 - DNA, 13 bp, C. elegans
tgattttttcaat

SEQ ID NO: 730040 - DNA, 13 bp, C. elegans
tgattttttcaca

SEQ ID NO: 730041 - DNA, 13 bp, C. elegans
tgattttttcgat

SEQ ID NO: 730042 - DNA, 13 bp, C. elegans
tgattttttgaaa

SEQ ID NO: 730043 - DNA, 13 bp, C. elegans
tgattttttgcac

SEQ ID NO: 730044 - DNA, 13 bp, C. elegans
tgattttttgcag

SEQ ID NO: 730045 - DNA, 13 bp, C. elegans
tgattttttgcca

SEQ ID NO: 730046 - DNA, 13 bp, C. elegans
tgatttttttcaa

SEQ ID NO: 730047 - DNA, 13 bp, C. elegans
tgcaaaaaaatgt

SEQ ID NO: 730048 - DNA, 13 bp, C. elegans
tgcaaaaaaattg

SEQ ID NO: 730049 - DNA, 13 bp, C. elegans
tgcaaaaaacatc

SEQ ID NO: 730050 - DNA, 13 bp, C. elegans
tgcaaaaaacatt

SEQ ID NO: 730051 - DNA, 13 bp, C. elegans
tgcaaaaaagatg

SEQ ID NO: 730052 - DNA, 13 bp, C. elegans
tgcaaaaaaggaa

SEQ ID NO: 730053 - DNA, 13 bp, C. elegans
tgcaaaaaaggat

SEQ ID NO: 730054 - DNA, 13 bp, C. elegans
tgcaaaaaagtgt

SEQ ID NO: 730055 - DNA, 13 bp, C. elegans
tgcaaaaaagtta

SEQ ID NO: 730056 - DNA, 13 bp, C. elegans
tgcaaaaaatata

SEQ ID NO: 730057 - DNA, 13 bp, C. elegans
tgcaaaaaatgaa

SEQ ID NO: 730058 - DNA, 13 bp, C. elegans
tgcaaaaaatgga

SEQ ID NO: 730059 - DNA, 13 bp, C. elegans
tgcaaaaaatgtt

SEQ ID NO: 730060 - DNA, 13 bp, C. elegans
tgcaaaaaattat

SEQ ID NO: 730061 - DNA, 13 bp, C. elegans
tgcaaaaaatttt

SEQ ID NO: 730062 - DNA, 13 bp, C. elegans
tgcaaaaacatta

SEQ ID NO: 730063 - DNA, 13 bp, C. elegans
tgcaaaaactaca

SEQ ID NO: 730064 - DNA, 13 bp, C. elegans
tgcaaaaactgaa

SEQ ID NO: 730065 - DNA, 13 bp, C. elegans
tgcaaaaagagaa

SEQ ID NO: 730066 - DNA, 13 bp, C. elegans
tgcaaaaagttaa

SEQ ID NO: 730067 - DNA, 13 bp, C. elegans
tgcaaaaagttga

SEQ ID NO: 730068 - DNA, 13 bp, C. elegans
tgcaaaaatatat

SEQ ID NO: 730069 - DNA, 13 bp, C. elegans
tgcaaaaatattt

SEQ ID NO: 730070 - DNA, 13 bp, C. elegans
tgcaaaaatcaaa

SEQ ID NO: 730071 - DNA, 13 bp, C. elegans
tgcaaaaatgatg

SEQ ID NO: 730072 - DNA, 13 bp, C. elegans
tgcaaaaatgctc

SEQ ID NO: 730073 - DNA, 13 bp, C. elegans
tgcaaaaatggtt

SEQ ID NO: 730074 - DNA, 13 bp, C. elegans
tgcaaaaattact

SEQ ID NO: 730075 - DNA, 13 bp, C. elegans
tgcaaaaattgaa

SEQ ID NO: 730076 - DNA, 13 bp, C. elegans
tgcaaaaattgat

SEQ ID NO: 730077 - DNA, 13 bp, C. elegans
tgcaaaacaaaag

SEQ ID NO: 730078 - DNA, 13 bp, C. elegans
tgcaaaaccaaaa

SEQ ID NO: 730079 - DNA, 13 bp, C. elegans
tgcaaaaccacaa

SEQ ID NO: 730080 - DNA, 13 bp, C. elegans
tgcaaaacgtttt

SEQ ID NO: 730081 - DNA, 13 bp, C. elegans
tgcaaaactacaa

SEQ ID NO: 730082 - DNA, 13 bp, C. elegans
tgcaaaactgaaa

SEQ ID NO: 730083 - DNA, 13 bp, C. elegans
tgcaaaactgcaa

SEQ ID NO: 730084 - DNA, 13 bp, C. elegans
tgcaaaataaatt

SEQ ID NO: 730085 - DNA, 13 bp, C. elegans
tgcaaaatacaat

SEQ ID NO: 730086 - DNA, 13 bp, C. elegans
tgcaaaatatata

SEQ ID NO: 730087 - DNA, 13 bp, C. elegans
tgcaaaatatcaa

SEQ ID NO: 730088 - DNA, 13 bp, C. elegans
tgcaaaatattaa

SEQ ID NO: 730089 - DNA, 13 bp, C. elegans
tgcaaaatattca

SEQ ID NO: 730090 - DNA, 13 bp, C. elegans
tgcaaaatcacaa

SEQ ID NO: 730091 - DNA, 13 bp, C. elegans
tgcaaaatcagtt

SEQ ID NO: 730092 - DNA, 13 bp, C. elegans
tgcaaaatggaaa

SEQ ID NO: 730093 - DNA, 13 bp, C. elegans
tgcaaaatgtcgt

SEQ ID NO: 730094 - DNA, 13 bp, C. elegans
tgcaaaatgtgaa

SEQ ID NO: 730095 - DNA, 13 bp, C. elegans
tgcaaaatgtttc

SEQ ID NO: 730096 - DNA, 13 bp, C. elegans
tgcaaaattagaa

SEQ ID NO: 730097 - DNA, 13 bp, C. elegans
tgcaaaattatca

SEQ ID NO: 730098 - DNA, 13 bp, C. elegans
tgcaaaattatct

SEQ ID NO: 730099 - DNA, 13 bp, C. elegans
tgcaaaattattt

SEQ ID NO: 730100 - DNA, 13 bp, C. elegans
tgcaaaattcttt

SEQ ID NO: 730101 - DNA, 13 bp, C. elegans
tgcaaaattggtt

SEQ ID NO: 730102 - DNA, 13 bp, C. elegans
tgcaaaattgtca

SEQ ID NO: 730103 - DNA, 13 bp, C. elegans
tgcaaaattgttt

SEQ ID NO: 730104 - DNA, 13 bp, C. elegans
tgcaaaatttaaa

SEQ ID NO: 730105 - DNA, 13 bp, C. elegans
tgcaaaatttcca

SEQ ID NO: 730106 - DNA, 13 bp, C. elegans
tgcaaaatttcta

SEQ ID NO: 730107 - DNA, 13 bp, C. elegans
tgcaaaatttgaa

SEQ ID NO: 730108 - DNA, 13 bp, C. elegans
tgcaaaatttggc

SEQ ID NO: 730109 - DNA, 13 bp, C. elegans
tgcaaaattttga

SEQ ID NO: 730110 - DNA, 13 bp, C. elegans
tgcaaaattttgc

SEQ ID NO: 730111 - DNA, 13 bp, C. elegans
tgcaaaattttta

SEQ ID NO: 730112 - DNA, 13 bp, C. elegans
tgcaaacgtgctc

SEQ ID NO: 730113 - DNA, 13 bp, C. elegans
tgcaaacttttcc

SEQ ID NO: 730114 - DNA, 13 bp, C. elegans
tgcaaactttttt

SEQ ID NO: 730115 - DNA, 13 bp, C. elegans
tgcaaaggaatgt

SEQ ID NO: 730116 - DNA, 13 bp, C. elegans
tgcaaagttgttt

SEQ ID NO: 730117 - DNA, 13 bp, C. elegans
tgcaaagtttgaa

SEQ ID NO: 730118 - DNA, 13 bp, C. elegans
tgcaaagttttga

SEQ ID NO: 730119 - DNA, 13 bp, C. elegans
tgcaaataaaaat

SEQ ID NO: 730120 - DNA, 13 bp, C. elegans
tgcaaataaattt

SEQ ID NO: 730121 - DNA, 13 bp, C. elegans
tgcaaataatatt

SEQ ID NO: 730122 - DNA, 13 bp, C. elegans
tgcaaataattaa

SEQ ID NO: 730123 - DNA, 13 bp, C. elegans
tgcaaataggaaa

SEQ ID NO: 730124 - DNA, 13 bp, C. elegans
tgcaaatattata

SEQ ID NO: 730125 - DNA, 13 bp, C. elegans
tgcaaatgcgctc

SEQ ID NO: 730126 - DNA, 13 bp, C. elegans
tgcaaatggaaaa

SEQ ID NO: 730127 - DNA, 13 bp, C. elegans
tgcaaattattaa

SEQ ID NO: 730128 - DNA, 13 bp, C. elegans
tgcaaattcaaaa

SEQ ID NO: 730129 - DNA, 13 bp, C. elegans
tgcaaattcaaat

SEQ ID NO: 730130 - DNA, 13 bp, C. elegans
tgcaaattcatct

SEQ ID NO: 730131 - DNA, 13 bp, C. elegans
tgcaaattccaag

SEQ ID NO: 730132 - DNA, 13 bp, C. elegans
tgcaaattgtaat

SEQ ID NO: 730133 - DNA, 13 bp, C. elegans
tgcaaattgttca

SEQ ID NO: 730134 - DNA, 13 bp, C. elegans
tgcaaatttcaaa

SEQ ID NO: 730135 - DNA, 13 bp, C. elegans
tgcaaatttggaa

SEQ ID NO: 730136 - DNA, 13 bp, C. elegans
tgcaaattttaat

SEQ ID NO: 730137 - DNA, 13 bp, C. elegans
tgcaaattttcaa

SEQ ID NO: 730138 - DNA, 13 bp, C. elegans
tgcaaattttgca

SEQ ID NO: 730139 - DNA, 13 bp, C. elegans
tgcaaattttttc

SEQ ID NO: 730140 - DNA, 13 bp, C. elegans
tgcaaattttttg

SEQ ID NO: 730141 - DNA, 13 bp, C. elegans
tgcaacaaaaaag

SEQ ID NO: 730142 - DNA, 13 bp, C. elegans
tgcaacaaaaagg

SEQ ID NO: 730143 - DNA, 13 bp, C. elegans
tgcaacaaaaata

SEQ ID NO: 730144 - DNA, 13 bp, C. elegans
tgcaacaaaatat

SEQ ID NO: 730145 - DNA, 13 bp, C. elegans
tgcaacaaaatgt

SEQ ID NO: 730146 - DNA, 13 bp, C. elegans
tgcaacaaagttt

SEQ ID NO: 730147 - DNA, 13 bp, C. elegans
tgcaacaacaaaa

SEQ ID NO: 730148 - DNA, 13 bp, C. elegans
tgcaacaactttt

SEQ ID NO: 730149 - DNA, 13 bp, C. elegans
tgcaacagttttt

SEQ ID NO: 730150 - DNA, 13 bp, C. elegans
tgcaacattttta

SEQ ID NO: 730151 - DNA, 27 bp, C. elegans
tgcaacgaagctcgtcgtaacatgtgt

SEQ ID NO: 730152 - DNA, 13 bp, C. elegans
tgcaacttcaaag

SEQ ID NO: 730153 - DNA, 13 bp, C. elegans
tgcaactttgaaa

SEQ ID NO: 730154 - DNA, 13 bp, C. elegans
tgcaactttttca

SEQ ID NO: 730155 - DNA, 13 bp, C. elegans
tgcaagaaatatt

SEQ ID NO: 730156 - DNA, 13 bp, C. elegans
tgcaagaattgaa

SEQ ID NO: 730157 - DNA, 13 bp, C. elegans
tgcaagcgcgctc

SEQ ID NO: 730158 - DNA, 13 bp, C. elegans
tgcaagtgcgccc

SEQ ID NO: 730159 - DNA, 13 bp, C. elegans
tgcaagtgcgctc

SEQ ID NO: 730160 - DNA, 13 bp, C. elegans
tgcaatacgtatt

SEQ ID NO: 730161 - DNA, 13 bp, C. elegans
tgcaatataattt

SEQ ID NO: 730162 - DNA, 13 bp, C. elegans
tgcaatattaaat

SEQ ID NO: 730163 - DNA, 13 bp, C. elegans
tgcaatattttct

SEQ ID NO: 730164 - DNA, 13 bp, C. elegans
tgcaattaaaaaa

SEQ ID NO: 730165 - DNA, 13 bp, C. elegans
tgcaattattatt

SEQ ID NO: 730166 - DNA, 13 bp, C. elegans
tgcaattcaaatt

SEQ ID NO: 730167 - DNA, 13 bp, C. elegans
tgcaattctaata

SEQ ID NO: 730168 - DNA, 13 bp, C. elegans
tgcaattgaaaat

SEQ ID NO: 730169 - DNA, 13 bp, C. elegans
tgcaattgcgctc

SEQ ID NO: 730170 - DNA, 13 bp, C. elegans
tgcaatttatctt

SEQ ID NO: 730171 - DNA, 13 bp, C. elegans
tgcaatttcaatc

SEQ ID NO: 730172 - DNA, 13 bp, C. elegans
tgcaatttgaaaa

SEQ ID NO: 730173 - DNA, 13 bp, C. elegans
tgcaatttgtcgt

SEQ ID NO: 730174 - DNA, 13 bp, C. elegans
tgcaatttgttgt

SEQ ID NO: 730175 - DNA, 13 bp, C. elegans
tgcaattttaaat

SEQ ID NO: 730176 - DNA, 13 bp, C. elegans
tgcaattttaata

SEQ ID NO: 730177 - DNA, 13 bp, C. elegans
tgcaattttattt

SEQ ID NO: 730178 - DNA, 13 bp, C. elegans
tgcaattttcaaa

SEQ ID NO: 730179 - DNA, 13 bp, C. elegans
tgcaattttcact

SEQ ID NO: 730180 - DNA, 13 bp, C. elegans
tgcaattttccag

SEQ ID NO: 730181 - DNA, 13 bp, C. elegans
tgcaattttctga

SEQ ID NO: 730182 - DNA, 13 bp, C. elegans
tgcaattttgaat

SEQ ID NO: 730183 - DNA, 13 bp, C. elegans
tgcaattttgatt

SEQ ID NO: 730184 - DNA, 13 bp, C. elegans
tgcaattttgcgt

SEQ ID NO: 730185 - DNA, 13 bp, C. elegans
tgcaatttttctc

SEQ ID NO: 730186 - DNA, 13 bp, C. elegans
tgcaatttttgac

SEQ ID NO: 730187 - DNA, 13 bp, C. elegans
tgcaatttttgtc

SEQ ID NO: 730188 - DNA, 13 bp, C. elegans
tgcaattttttca

SEQ ID NO: 730189 - DNA, 13 bp, C. elegans
tgcaattttttct

SEQ ID NO: 730190 - DNA, 13 bp, C. elegans
tgcacaaaaaatg

SEQ ID NO: 730191 - DNA, 13 bp, C. elegans
tgcacaaaaagtg

SEQ ID NO: 730192 - DNA, 13 bp, C. elegans
tgcacaaaaagtt

SEQ ID NO: 730193 - DNA, 13 bp, C. elegans
tgcacaaaaataa

SEQ ID NO: 730194 - DNA, 13 bp, C. elegans
tgcacaaaaatcg

SEQ ID NO: 730195 - DNA, 13 bp, C. elegans
tgcacaaaaattg

SEQ ID NO: 730196 - DNA, 13 bp, C. elegans
tgcacaaaatcga

SEQ ID NO: 730197 - DNA, 13 bp, C. elegans
tgcacaaagagca

SEQ ID NO: 730198 - DNA, 13 bp, C. elegans
tgcacaaattaaa

SEQ ID NO: 730199 - DNA, 13 bp, C. elegans
tgcacaaattgaa

SEQ ID NO: 730200 - DNA, 13 bp, C. elegans
tgcacaatgtgca

SEQ ID NO: 730201 - DNA, 13 bp, C. elegans
tgcacaatgtttt

SEQ ID NO: 730202 - DNA, 13 bp, C. elegans
tgcacaattttga

SEQ ID NO: 730203 - DNA, 13 bp, C. elegans
tgcacacaatttt

SEQ ID NO: 730204 - DNA, 13 bp, C. elegans
tgcacattgtgca

SEQ ID NO: 730205 - DNA, 13 bp, C. elegans
tgcacattttcca

SEQ ID NO: 730206 - DNA, 13 bp, C. elegans
tgcaccaaaaatt

SEQ ID NO: 730207 - DNA, 13 bp, C. elegans
tgcaccatgttca

SEQ ID NO: 730208 - DNA, 13 bp, C. elegans
tgcacctttaaaa

SEQ ID NO: 730209 - DNA, 13 bp, C. elegans
tgcactaaaactt

SEQ ID NO: 730210 - DNA, 13 bp, C. elegans
tgcactatttttt

SEQ ID NO: 730211 - DNA, 13 bp, C. elegans
tgcactgaccaac

SEQ ID NO: 730212 - DNA, 13 bp, C. elegans
tgcacttaaaaaa

SEQ ID NO: 730213 - DNA, 13 bp, C. elegans
tgcacttttccaa

SEQ ID NO: 730214 - DNA, 13 bp, C. elegans
tgcacttttgaaa

SEQ ID NO: 730215 - DNA, 13 bp, C. elegans
tgcactttttaaa

SEQ ID NO: 730216 - DNA, 13 bp, C. elegans
tgcactttttctg

SEQ ID NO: 730217 - DNA, 13 bp, C. elegans
tgcagaaacattt

SEQ ID NO: 730218 - DNA, 13 bp, C. elegans
tgcagaaattgaa

SEQ ID NO: 730219 - DNA, 13 bp, C. elegans
tgcagattttcaa

SEQ ID NO: 730220 - DNA, 13 bp, C. elegans
tgcagcaaaaaag

SEQ ID NO: 730221 - DNA, 13 bp, C. elegans
tgcagcagcagca

SEQ ID NO: 730222 - DNA, 13 bp, C. elegans
tgcagctaatttt

SEQ ID NO: 730223 - DNA, 13 bp, C. elegans
tgcaggaaaaaaa

SEQ ID NO: 730224 - DNA, 13 bp, C. elegans
tgcagtacgcatt

SEQ ID NO: 730225 - DNA, 13 bp, C. elegans
tgcagtgccaaac

SEQ ID NO: 730226 - DNA, 13 bp, C. elegans
tgcagtggagcga

SEQ ID NO: 730227 - DNA, 13 bp, C. elegans
tgcagtggagcgc

SEQ ID NO: 730228 - DNA, 13 bp, C. elegans
tgcagttctcatt

SEQ ID NO: 730229 - DNA, 13 bp, C. elegans
tgcagttgaaaat

SEQ ID NO: 730230 - DNA, 13 bp, C. elegans
tgcagttttcaaa

SEQ ID NO: 730231 - DNA, 13 bp, C. elegans
tgcagttttcaat

SEQ ID NO: 730232 - DNA, 13 bp, C. elegans
tgcagttttttgt

SEQ ID NO: 730233 - DNA, 13 bp, C. elegans
tgcataacttttt

SEQ ID NO: 730234 - DNA, 13 bp, C. elegans
tgcataatatttt

SEQ ID NO: 730235 - DNA, 13 bp, C. elegans
tgcatcacaaaaa

SEQ ID NO: 730236 - DNA, 13 bp, C. elegans
tgcatcacttttt

SEQ ID NO: 730237 - DNA, 13 bp, C. elegans
tgcatcgaccaaa

SEQ ID NO: 730238 - DNA, 13 bp, C. elegans
tgcatcgattttt

SEQ ID NO: 730239 - DNA, 13 bp, C. elegans
tgcatctgttttt

SEQ ID NO: 730240 - DNA, 13 bp, C. elegans
tgcatgaaaaatt

SEQ ID NO: 730241 - DNA, 13 bp, C. elegans
tgcatgcctacct

SEQ ID NO: 730242 - DNA, 13 bp, C. elegans
tgcatgtattgat

SEQ ID NO: 730243 - DNA, 13 bp, C. elegans
tgcatgtttaata

SEQ ID NO: 730244 - DNA, 13 bp, C. elegans
tgcatgttttggc

SEQ ID NO: 730245 - DNA, 13 bp, C. elegans
tgcatgtttttca

SEQ ID NO: 730246 - DNA, 13 bp, C. elegans
tgcattaaaaaag

SEQ ID NO: 730247 - DNA, 13 bp, C. elegans
tgcattatttcaa

SEQ ID NO: 730248 - DNA, 13 bp, C. elegans
tgcattctgtttt

SEQ ID NO: 730249 - DNA, 13 bp, C. elegans
tgcattgttttta

SEQ ID NO: 730250 - DNA, 13 bp, C. elegans
tgcatttaaaaat

SEQ ID NO: 730251 - DNA, 13 bp, C. elegans
tgcatttattgaa

SEQ ID NO: 730252 - DNA, 13 bp, C. elegans
tgcatttattttg

SEQ ID NO: 730253 - DNA, 13 bp, C. elegans
tgcatttcaaaaa

SEQ ID NO: 730254 - DNA, 13 bp, C. elegans
tgcatttcaaaat

SEQ ID NO: 730255 - DNA, 13 bp, C. elegans
tgcatttcatttt

SEQ ID NO: 730256 - DNA, 13 bp, C. elegans
tgcatttcctatg

SEQ ID NO: 730257 - DNA, 13 bp, C. elegans
tgcatttctgaaa

SEQ ID NO: 730258 - DNA, 13 bp, C. elegans
tgcattttaatga

SEQ ID NO: 730259 - DNA, 13 bp, C. elegans
tgcattttcaatt

SEQ ID NO: 730260 - DNA, 13 bp, C. elegans
tgcattttctctt

SEQ ID NO: 730261 - DNA, 13 bp, C. elegans
tgcattttggcgt

SEQ ID NO: 730262 - DNA, 13 bp, C. elegans
tgcattttgtaaa

SEQ ID NO: 730263 - DNA, 13 bp, C. elegans
tgcattttgtagg

SEQ ID NO: 730264 - DNA, 13 bp, C. elegans
tgcatttttatgt

SEQ ID NO: 730265 - DNA, 13 bp, C. elegans
tgcatttttcaaa

SEQ ID NO: 730266 - DNA, 13 bp, C. elegans
tgcatttttcaat

SEQ ID NO: 730267 - DNA, 13 bp, C. elegans
tgcatttttcagt

SEQ ID NO: 730268 - DNA, 13 bp, C. elegans
tgcatttttcgcg

SEQ ID NO: 730269 - DNA, 13 bp, C. elegans
tgcatttttcgtc

SEQ ID NO: 730270 - DNA, 13 bp, C. elegans
tgcatttttctag

SEQ ID NO: 730271 - DNA, 13 bp, C. elegans
tgcatttttctca

SEQ ID NO: 730272 - DNA, 13 bp, C. elegans
tgcattttttgca

SEQ ID NO: 730273 - DNA, 13 bp, C. elegans
tgcattttttgct

SEQ ID NO: 730274 - DNA, 13 bp, C. elegans
tgcattttttgta

SEQ ID NO: 730275 - DNA, 13 bp, C. elegans
tgccaaaaacttt

SEQ ID NO: 730276 - DNA, 13 bp, C. elegans
tgccaaaaagtcg

SEQ ID NO: 730277 - DNA, 13 bp, C. elegans
tgccaaaaatcaa

SEQ ID NO: 730278 - DNA, 13 bp, C. elegans
tgccaaaaatgtg

SEQ ID NO: 730279 - DNA, 13 bp, C. elegans
tgccaaaaatttt

SEQ ID NO: 730280 - DNA, 13 bp, C. elegans
tgccaaaacttga

SEQ ID NO: 730281 - DNA, 13 bp, C. elegans
tgccaaaactttg

SEQ ID NO: 730282 - DNA, 13 bp, C. elegans
tgccaaaatattt

SEQ ID NO: 730283 - DNA, 13 bp, C. elegans
tgccaaaatgatt

SEQ ID NO: 730284 - DNA, 13 bp, C. elegans
tgccaaaatgcca

SEQ ID NO: 730285 - DNA, 13 bp, C. elegans
tgccaaaatggcc

SEQ ID NO: 730286 - DNA, 13 bp, C. elegans
tgccaaaattcag

SEQ ID NO: 730287 - DNA, 13 bp, C. elegans
tgccaaaattgtt

SEQ ID NO: 730288 - DNA, 13 bp, C. elegans
tgccaaaatttcc

SEQ ID NO: 730289 - DNA, 13 bp, C. elegans
tgccaaaattttg

SEQ ID NO: 730290 - DNA, 13 bp, C. elegans
tgccaaacatttt

SEQ ID NO: 730291 - DNA, 13 bp, C. elegans
tgccaaacttgcc

SEQ ID NO: 730292 - DNA, 13 bp, C. elegans
tgccaaacttttg

SEQ ID NO: 730293 - DNA, 13 bp, C. elegans
tgccaaatcagct

SEQ ID NO: 730294 - DNA, 13 bp, C. elegans
tgccaaatcggca

SEQ ID NO: 730295 - DNA, 13 bp, C. elegans
tgccaaattgcca

SEQ ID NO: 730296 - DNA, 13 bp, C. elegans
tgccaaattttgg

SEQ ID NO: 730297 - DNA, 13 bp, C. elegans
tgccaacaatttt

SEQ ID NO: 730298 - DNA, 13 bp, C. elegans
tgccaaccttgtt

SEQ ID NO: 730299 - DNA, 13 bp, C. elegans
tgccaagaaatgg

SEQ ID NO: 730300 - DNA, 14 bp, C. elegans
tgccaagagatatt

SEQ ID NO: 730301 - DNA, 13 bp, C. elegans
tgccaagttcaag

SEQ ID NO: 730302 - DNA, 13 bp, C. elegans
tgccaatatattt

SEQ ID NO: 730303 - DNA, 13 bp, C. elegans
tgccaatattcaa

SEQ ID NO: 730304 - DNA, 14 bp, C. elegans
tgccaatggagcgc

SEQ ID NO: 730305 - DNA, 13 bp, C. elegans
tgccaattgaaaa

SEQ ID NO: 730306 - DNA, 13 bp, C. elegans
tgccaatttattt

SEQ ID NO: 730307 - DNA, 13 bp, C. elegans
tgccaatttgtca

SEQ ID NO: 730308 - DNA, 13 bp, C. elegans
tgccaattttcat

SEQ ID NO: 730309 - DNA, 13 bp, C. elegans
tgccaattttctc

SEQ ID NO: 730310 - DNA, 13 bp, C. elegans
tgccaattttctt

SEQ ID NO: 730311 - DNA, 13 bp, C. elegans
tgccaatttttca

SEQ ID NO: 730312 - DNA, 13 bp, C. elegans
tgccaatttttcc

SEQ ID NO: 730313 - DNA, 13 bp, C. elegans
tgccaatttttgc

SEQ ID NO: 730314 - DNA, 13 bp, C. elegans
tgccacgtcatca

SEQ ID NO: 730315 - DNA, 13 bp, C. elegans
tgccacgtcatct

SEQ ID NO: 730316 - DNA, 13 bp, C. elegans
tgccacgtcatta

SEQ ID NO: 730317 - DNA, 13 bp, C. elegans
tgccacgtggaaa

SEQ ID NO: 730318 - DNA, 13 bp, C. elegans
tgccacgtggcaa

SEQ ID NO: 730319 - DNA, 13 bp, C. elegans
tgccacgtgtcac

SEQ ID NO: 730320 - DNA, 13 bp, C. elegans
tgccacttttttt

SEQ ID NO: 730321 - DNA, 13 bp, C. elegans
tgccagaaatttt

SEQ ID NO: 730322 - DNA, 13 bp, C. elegans
tgccagaattgaa

SEQ ID NO: 730323 - DNA, 13 bp, C. elegans
tgccagtttttct

SEQ ID NO: 730324 - DNA, 13 bp, C. elegans
tgccagtttttga

SEQ ID NO: 730325 - DNA, 13 bp, C. elegans
tgccagttttttt

SEQ ID NO: 730326 - DNA, 13 bp, C. elegans
tgccataactttt

SEQ ID NO: 730327 - DNA, 13 bp, C. elegans
tgccatttcaaaa

SEQ ID NO: 730328 - DNA, 13 bp, C. elegans
tgccattttcaat

SEQ ID NO: 730329 - DNA, 13 bp, C. elegans
tgccattttgcca

SEQ ID NO: 730330 - DNA, 13 bp, C. elegans
tgccatttttcaa

SEQ ID NO: 730331 - DNA, 13 bp, C. elegans
tgccatttttcta

SEQ ID NO: 730332 - DNA, 13 bp, C. elegans
tgccatttttgaa

SEQ ID NO: 730333 - DNA, 13 bp, C. elegans
tgcccaaattttc

SEQ ID NO: 730334 - DNA, 13 bp, C. elegans
tgcccaaattttt

SEQ ID NO: 730335 - DNA, 13 bp, C. elegans
tgcccaactggaa

SEQ ID NO: 730336 - DNA, 13 bp, C. elegans
tgcccaatttttc

SEQ ID NO: 730337 - DNA, 13 bp, C. elegans
tgcccatttttct

SEQ ID NO: 730338 - DNA, 13 bp, C. elegans
tgccccatttcgg

SEQ ID NO: 730339 - DNA, 13 bp, C. elegans
tgcccttattttt

SEQ ID NO: 730340 - DNA, 13 bp, C. elegans
tgccctttgtaga

SEQ ID NO: 730341 - DNA, 13 bp, C. elegans
tgccgaaaaaaca

SEQ ID NO: 730342 - DNA, 13 bp, C. elegans
tgccgaaaaagaa

SEQ ID NO: 730343 - DNA, 13 bp, C. elegans
tgccgaaaaatca

SEQ ID NO: 730344 - DNA, 13 bp, C. elegans
tgccgaaaagttt

SEQ ID NO: 730345 - DNA, 13 bp, C. elegans
tgccgaaaataaa

SEQ ID NO: 730346 - DNA, 13 bp, C. elegans
tgccgaaaatgac

SEQ ID NO: 730347 - DNA, 13 bp, C. elegans
tgccgaaaatgtt

SEQ ID NO: 730348 - DNA, 13 bp, C. elegans
tgccgaaattacc

SEQ ID NO: 730349 - DNA, 13 bp, C. elegans
tgccgaaattcaa

SEQ ID NO: 730350 - DNA, 13 bp, C. elegans
tgccgaacatttt

SEQ ID NO: 730351 - DNA, 13 bp, C. elegans
tgccgaactgcaa

SEQ ID NO: 730352 - DNA, 13 bp, C. elegans
tgccgaatatttt

SEQ ID NO: 730353 - DNA, 13 bp, C. elegans
tgccgaatttgaa

SEQ ID NO: 730354 - DNA, 13 bp, C. elegans
tgccgaatttgac

SEQ ID NO: 730355 - DNA, 13 bp, C. elegans
tgccgaatttgtt

SEQ ID NO: 730356 - DNA, 14 bp, C. elegans
tgccgatttgccga

SEQ ID NO: 730357 - DNA, 13 bp, C. elegans
tgccgcagggttg

SEQ ID NO: 730358 - DNA, 13 bp, C. elegans
tgccgccaaatac

SEQ ID NO: 730359 - DNA, 13 bp, C. elegans
tgccgccagaaaa

SEQ ID NO: 730360 - DNA, 13 bp, C. elegans
tgccggaaaaatg

SEQ ID NO: 730361 - DNA, 13 bp, C. elegans
tgccggaaaactt

SEQ ID NO: 730362 - DNA, 13 bp, C. elegans
tgccggaaatctt

SEQ ID NO: 730363 - DNA, 13 bp, C. elegans
tgccggaaattca

SEQ ID NO: 730364 - DNA, 13 bp, C. elegans
tgccggaaatttg

SEQ ID NO: 730365 - DNA, 13 bp, C. elegans
tgccggaagtttc

SEQ ID NO: 730366 - DNA, 13 bp, C. elegans
tgccggaattaaa

SEQ ID NO: 730367 - DNA, 13 bp, C. elegans
tgccggaattgaa

SEQ ID NO: 730368 - DNA, 13 bp, C. elegans
tgccggacttgaa

SEQ ID NO: 730369 - DNA, 13 bp, C. elegans
tgccggcaatttt

SEQ ID NO: 730370 - DNA, 13 bp, C. elegans
tgccggcataatg

SEQ ID NO: 730371 - DNA, 13 bp, C. elegans
tgccgggaattgc

SEQ ID NO: 730372 - DNA, 13 bp, C. elegans
tgccggtgaaaat

SEQ ID NO: 730373 - DNA, 13 bp, C. elegans
tgccggttgccaa

SEQ ID NO: 730374 - DNA, 13 bp, C. elegans
tgccggttttcaa

SEQ ID NO: 730375 - DNA, 13 bp, C. elegans
tgccggttttcga

SEQ ID NO: 730376 - DNA, 13 bp, C. elegans
tgccgttttctgc

SEQ ID NO: 730377 - DNA, 13 bp, C. elegans
tgccgttttgccg

SEQ ID NO: 730378 - DNA, 13 bp, C. elegans
tgccgttttttcc

SEQ ID NO: 730379 - DNA, 13 bp, C. elegans
tgcctaaaatttt

SEQ ID NO: 730380 - DNA, 13 bp, C. elegans
tgcctacacgcct

SEQ ID NO: 730381 - DNA, 13 bp, C. elegans
tgcctacatgctt

SEQ ID NO: 730382 - DNA, 13 bp, C. elegans
tgcctaccgtttt

SEQ ID NO: 730383 - DNA, 13 bp, C. elegans
tgcctacctgcct

SEQ ID NO: 730384 - DNA, 13 bp, C. elegans
tgcctacgtgcct

SEQ ID NO: 730385 - DNA, 13 bp, C. elegans
tgcctacttcatg

SEQ ID NO: 730386 - DNA, 13 bp, C. elegans
tgcctattttgca

SEQ ID NO: 730387 - DNA, 13 bp, C. elegans
tgcctccaacctg

SEQ ID NO: 730388 - DNA, 13 bp, C. elegans
tgcctgaaaatct

SEQ ID NO: 730389 - DNA, 13 bp, C. elegans
tgcctgcctacat

SEQ ID NO: 730390 - DNA, 13 bp, C. elegans
tgcctgcctactg

SEQ ID NO: 730391 - DNA, 13 bp, C. elegans
tgcctgcctgccg

SEQ ID NO: 730392 - DNA, 13 bp, C. elegans
tgcctgcctgcct

SEQ ID NO: 730393 - DNA, 13 bp, C. elegans
tgcctgcgtgcct

SEQ ID NO: 730394 - DNA, 13 bp, C. elegans
tgcctgcgtggtt

SEQ ID NO: 730395 - DNA, 13 bp, C. elegans
tgccttatcaaga

SEQ ID NO: 730396 - DNA, 13 bp, C. elegans
tgccttcttccta

SEQ ID NO: 730397 - DNA, 13 bp, C. elegans
tgcgaaaaaaata

SEQ ID NO: 730398 - DNA, 13 bp, C. elegans
tgcgaaaaaagaa

SEQ ID NO: 730399 - DNA, 13 bp, C. elegans
tgcgaaaaatcgg

SEQ ID NO: 730400 - DNA, 13 bp, C. elegans
tgcgaaattttgc

SEQ ID NO: 730401 - DNA, 13 bp, C. elegans
tgcgaattttttc

SEQ ID NO: 730402 - DNA, 13 bp, C. elegans
tgcgacaccgaga

SEQ ID NO: 730403 - DNA, 13 bp, C. elegans
tgcgacattgata

SEQ ID NO: 730404 - DNA, 13 bp, C. elegans
tgcgattttaatc

SEQ ID NO: 730405 - DNA, 13 bp, C. elegans
tgcgatttttgcc

SEQ ID NO: 730406 - DNA, 13 bp, C. elegans
tgcgatttttgct

SEQ ID NO: 730407 - DNA, 13 bp, C. elegans
tgcgatttttttg

SEQ ID NO: 730408 - DNA, 13 bp, C. elegans
tgcgccaaaaata

SEQ ID NO: 730409 - DNA, 13 bp, C. elegans
tgcgccaaatttt

SEQ ID NO: 730410 - DNA, 13 bp, C. elegans
tgcgccaaggcac

SEQ ID NO: 730411 - DNA, 13 bp, C. elegans
tgcgcctttaagg

SEQ ID NO: 730412 - DNA, 13 bp, C. elegans
tgcgcctttgaag

SEQ ID NO: 730413 - DNA, 13 bp, C. elegans
tgcgcgtaagata

SEQ ID NO: 730414 - DNA, 13 bp, C. elegans
tgcgcgtcaaatt

SEQ ID NO: 730415 - DNA, 13 bp, C. elegans
tgcgctccactga

SEQ ID NO: 730416 - DNA, 13 bp, C. elegans
tgcgctccatcga

SEQ ID NO: 730417 - DNA, 13 bp, C. elegans
tgcgctccattga

SEQ ID NO: 730418 - DNA, 13 bp, C. elegans
tgcggaaattttt

SEQ ID NO: 730419 - DNA, 13 bp, C. elegans
tgcgggagaagtg

SEQ ID NO: 730420 - DNA, 13 bp, C. elegans
tgcgtatcgtgca

SEQ ID NO: 730421 - DNA, 13 bp, C. elegans
tgcgtattacaca

SEQ ID NO: 730422 - DNA, 13 bp, C. elegans
tgcgtcgcggtcg

SEQ ID NO: 730423 - DNA, 13 bp, C. elegans
tgcgtctcaattc

SEQ ID NO: 730424 - DNA, 13 bp, C. elegans
tgcgtctctcctc

SEQ ID NO: 730425 - DNA, 13 bp, C. elegans
tgcgtcttttctc

SEQ ID NO: 730426 - DNA, 13 bp, C. elegans
tgctaaaaacttt

SEQ ID NO: 730427 - DNA, 13 bp, C. elegans
tgctaaaaataaa

SEQ ID NO: 730428 - DNA, 13 bp, C. elegans
tgctaaaaatcag

SEQ ID NO: 730429 - DNA, 13 bp, C. elegans
tgctaaaaatttg

SEQ ID NO: 730430 - DNA, 13 bp, C. elegans
tgctaaaataatt

SEQ ID NO: 730431 - DNA, 13 bp, C. elegans
tgctaaaattacc

SEQ ID NO: 730432 - DNA, 13 bp, C. elegans
tgctaaatttttg

SEQ ID NO: 730433 - DNA, 13 bp, C. elegans
tgctaattattta

SEQ ID NO: 730434 - DNA, 13 bp, C. elegans
tgctaattcaatt

SEQ ID NO: 730435 - DNA, 13 bp, C. elegans
tgctaattttttg

SEQ ID NO: 730436 - DNA, 13 bp, C. elegans
tgctatagaagtt

SEQ ID NO: 730437 - DNA, 13 bp, C. elegans
tgctatcaaaatt

SEQ ID NO: 730438 - DNA, 13 bp, C. elegans
tgctcaaaaaatt

SEQ ID NO: 730439 - DNA, 13 bp, C. elegans
tgctcaaaaacat

SEQ ID NO: 730440 - DNA, 13 bp, C. elegans
tgctcaaaaactg

SEQ ID NO: 730441 - DNA, 13 bp, C. elegans
tgctcaaaaatca

SEQ ID NO: 730442 - DNA, 13 bp, C. elegans
tgctcaaaaatcc

SEQ ID NO: 730443 - DNA, 13 bp, C. elegans
tgctcaaaaatct

SEQ ID NO: 730444 - DNA, 13 bp, C. elegans
tgctcaaaatatt

SEQ ID NO: 730445 - DNA, 13 bp, C. elegans
tgctcaaaatgcc

SEQ ID NO: 730446 - DNA, 13 bp, C. elegans
tgctcaaaatgtt

SEQ ID NO: 730447 - DNA, 13 bp, C. elegans
tgctcaaagagca

SEQ ID NO: 730448 - DNA, 13 bp, C. elegans
tgctcaaagtgct

SEQ ID NO: 730449 - DNA, 13 bp, C. elegans
tgctcaaattttg

SEQ ID NO: 730450 - DNA, 13 bp, C. elegans
tgctcaaattttt

SEQ ID NO: 730451 - DNA, 13 bp, C. elegans
tgctcaacatttt

SEQ ID NO: 730452 - DNA, 13 bp, C. elegans
tgctcaacttgaa

SEQ ID NO: 730453 - DNA, 13 bp, C. elegans
tgctcaatcaact

SEQ ID NO: 730454 - DNA, 13 bp, C. elegans
tgctcaatctcaa

SEQ ID NO: 730455 - DNA, 13 bp, C. elegans
tgctcaatgagca

SEQ ID NO: 730456 - DNA, 13 bp, C. elegans
tgctcaatgagcc

SEQ ID NO: 730457 - DNA, 13 bp, C. elegans
tgctcaatttcaa

SEQ ID NO: 730458 - DNA, 13 bp, C. elegans
tgctcaatttcct

SEQ ID NO: 730459 - DNA, 13 bp, C. elegans
tgctcaattttat

SEQ ID NO: 730460 - DNA, 13 bp, C. elegans
tgctcaattttcc

SEQ ID NO: 730461 - DNA, 13 bp, C. elegans
tgctcacatttcc

SEQ ID NO: 730462 - DNA, 13 bp, C. elegans
tgctcacggagca

SEQ ID NO: 730463 - DNA, 13 bp, C. elegans
tgctcactatcag

SEQ ID NO: 730464 - DNA, 13 bp, C. elegans
tgctcactgagca

SEQ ID NO: 730465 - DNA, 13 bp, C. elegans
tgctcagtttttg

SEQ ID NO: 730466 - DNA, 13 bp, C. elegans
tgctcatggtgca

SEQ ID NO: 730467 - DNA, 13 bp, C. elegans
tgctcattgagca

SEQ ID NO: 730468 - DNA, 13 bp, C. elegans
tgctcattgtgca

SEQ ID NO: 730469 - DNA, 13 bp, C. elegans
tgctcatttattt

SEQ ID NO: 730470 - DNA, 13 bp, C. elegans
tgctcattttcat

SEQ ID NO: 730471 - DNA, 13 bp, C. elegans
tgctcattttcta

SEQ ID NO: 730472 - DNA, 13 bp, C. elegans
tgctcattttgct

SEQ ID NO: 730473 - DNA, 13 bp, C. elegans
tgctcattttgtt

SEQ ID NO: 730474 - DNA, 13 bp, C. elegans
tgctcatttttag

SEQ ID NO: 730475 - DNA, 13 bp, C. elegans
tgctcatttttct

SEQ ID NO: 730476 - DNA, 13 bp, C. elegans
tgctcattttttg

SEQ ID NO: 730477 - DNA, 13 bp, C. elegans
tgctccaaaaata

SEQ ID NO: 730478 - DNA, 13 bp, C. elegans
tgctccaaatgct

SEQ ID NO: 730479 - DNA, 13 bp, C. elegans
tgctccaaatttg

SEQ ID NO: 730480 - DNA, 13 bp, C. elegans
tgctccaattttt

SEQ ID NO: 730481 - DNA, 13 bp, C. elegans
tgctccacttccc

SEQ ID NO: 730482 - DNA, 13 bp, C. elegans
tgctccatttttg

SEQ ID NO: 730483 - DNA, 13 bp, C. elegans
tgctccatttttt

SEQ ID NO: 730484 - DNA, 13 bp, C. elegans
tgctcccaatttt

SEQ ID NO: 730485 - DNA, 13 bp, C. elegans
tgctccgagagca

SEQ ID NO: 730486 - DNA, 13 bp, C. elegans
tgctccgcgagct

SEQ ID NO: 730487 - DNA, 13 bp, C. elegans
tgctcgccgagca

SEQ ID NO: 730488 - DNA, 14 bp, C. elegans
tgctcgcggagcac

SEQ ID NO: 730489 - DNA, 17 bp, C. elegans
tgctcgctggctgtctc

SEQ ID NO: 730490 - DNA, 13 bp, C. elegans
tgctcggcgagca

SEQ ID NO: 730491 - DNA, 13 bp, C. elegans
tgctctcagtttt

SEQ ID NO: 730492 - DNA, 13 bp, C. elegans
tgctctcattttt

SEQ ID NO: 730493 - DNA, 13 bp, C. elegans
tgctctcggagca

SEQ ID NO: 730494 - DNA, 13 bp, C. elegans
tgctctgaaaatt

SEQ ID NO: 730495 - DNA, 13 bp, C. elegans
tgctctttcaaac

SEQ ID NO: 730496 - DNA, 13 bp, C. elegans
tgctctttgtaga

SEQ ID NO: 730497 - DNA, 13 bp, C. elegans
tgctcttttacta

SEQ ID NO: 730498 - DNA, 13 bp, C. elegans
tgctcttttcaaa

SEQ ID NO: 730499 - DNA, 13 bp, C. elegans
tgctcttttcaat

SEQ ID NO: 730500 - DNA, 13 bp, C. elegans
tgctcttttgctc

SEQ ID NO: 730501 - DNA, 13 bp, C. elegans
tgctctttttgga

SEQ ID NO: 730502 - DNA, 13 bp, C. elegans
tgctgaaaaatct

SEQ ID NO: 730503 - DNA, 13 bp, C. elegans
tgctgaaaatcaa

SEQ ID NO: 730504 - DNA, 13 bp, C. elegans
tgctgaaaatgaa

SEQ ID NO: 730505 - DNA, 13 bp, C. elegans
tgctgaaaatgtg

SEQ ID NO: 730506 - DNA, 13 bp, C. elegans
tgctgaaaattaa

SEQ ID NO: 730507 - DNA, 13 bp, C. elegans
tgctgaaaattcc

SEQ ID NO: 730508 - DNA, 13 bp, C. elegans
tgctgaaaattgt

SEQ ID NO: 730509 - DNA, 13 bp, C. elegans
tgctgaaacagta

SEQ ID NO: 730510 - DNA, 13 bp, C. elegans
tgctgaaactacc

SEQ ID NO: 730511 - DNA, 13 bp, C. elegans
tgctgaaataaaa

SEQ ID NO: 730512 - DNA, 13 bp, C. elegans
tgctgaaattgaa

SEQ ID NO: 730513 - DNA, 13 bp, C. elegans
tgctgaaattgcc

SEQ ID NO: 730514 - DNA, 13 bp, C. elegans
tgctgaaatttat

SEQ ID NO: 730515 - DNA, 13 bp, C. elegans
tgctgaacatttt

SEQ ID NO: 730516 - DNA, 13 bp, C. elegans
tgctgaagagttt

SEQ ID NO: 730517 - DNA, 13 bp, C. elegans
tgctgaatttgcc

SEQ ID NO: 730518 - DNA, 13 bp, C. elegans
tgctgacgtcaca

SEQ ID NO: 730519 - DNA, 13 bp, C. elegans
tgctgatttttca

SEQ ID NO: 730520 - DNA, 13 bp, C. elegans
tgctgcagtctcc

SEQ ID NO: 730521 - DNA, 13 bp, C. elegans
tgctgcatttttt

SEQ ID NO: 730522 - DNA, 13 bp, C. elegans
tgctgctactgct

SEQ ID NO: 730523 - DNA, 13 bp, C. elegans
tgctgctgaaaaa

SEQ ID NO: 730524 - DNA, 13 bp, C. elegans
tgctgctgaaaat

SEQ ID NO: 730525 - DNA, 13 bp, C. elegans
tgctgctgctgct

SEQ ID NO: 730526 - DNA, 13 bp, C. elegans
tgctgcttcttct

SEQ ID NO: 730527 - DNA, 13 bp, C. elegans
tgctggaaatttt

SEQ ID NO: 730528 - DNA, 13 bp, C. elegans
tgctggaattgaa

SEQ ID NO: 730529 - DNA, 13 bp, C. elegans
tgctggaattgcc

SEQ ID NO: 730530 - DNA, 13 bp, C. elegans
tgctggcgcgttt

SEQ ID NO: 730531 - DNA, 13 bp, C. elegans
tgctggcggcaaa

SEQ ID NO: 730532 - DNA, 13 bp, C. elegans
tgctggtggatgg

SEQ ID NO: 730533 - DNA, 13 bp, C. elegans
tgcttaaaaattc

SEQ ID NO: 730534 - DNA, 13 bp, C. elegans
tgcttaaaaattg

SEQ ID NO: 730535 - DNA, 13 bp, C. elegans
tgcttatcaaaaa

SEQ ID NO: 730536 - DNA, 13 bp, C. elegans
tgcttatttttaa

SEQ ID NO: 730537 - DNA, 13 bp, C. elegans
tgcttcaaaaatc

SEQ ID NO: 730538 - DNA, 13 bp, C. elegans
tgcttcaaaagct

SEQ ID NO: 730539 - DNA, 13 bp, C. elegans
tgcttcattttca

SEQ ID NO: 730540 - DNA, 13 bp, C. elegans
tgcttctcaacaa

SEQ ID NO: 730541 - DNA, 13 bp, C. elegans
tgcttcttctcca

SEQ ID NO: 730542 - DNA, 13 bp, C. elegans
tgcttctttgagt

SEQ ID NO: 730543 - DNA, 13 bp, C. elegans
tgctttaaaaatt

SEQ ID NO: 730544 - DNA, 13 bp, C. elegans
tgctttacaattt

SEQ ID NO: 730545 - DNA, 13 bp, C. elegans
tgctttattttca

SEQ ID NO: 730546 - DNA, 13 bp, C. elegans
tgctttgatcttc

SEQ ID NO: 730547 - DNA, 13 bp, C. elegans
tgctttggaattt

SEQ ID NO: 730548 - DNA, 13 bp, C. elegans
tgctttttaatcg

SEQ ID NO: 730549 - DNA, 13 bp, C. elegans
tgctttttggaaa

SEQ ID NO: 730550 - DNA, 13 bp, C. elegans
tgcttttttcaat

SEQ ID NO: 730551 - DNA, 13 bp, C. elegans
tgcttttttgaat

SEQ ID NO: 730552 - DNA, 13 bp, C. elegans
tggaaaaaaaatc

SEQ ID NO: 730553 - DNA, 13 bp, C. elegans
tggaaaaaacgtc

SEQ ID NO: 730554 - DNA, 13 bp, C. elegans
tggaaaaaacttg

SEQ ID NO: 730555 - DNA, 13 bp, C. elegans
tggaaaaaagtag

SEQ ID NO: 730556 - DNA, 13 bp, C. elegans
tggaaaaaagtat

SEQ ID NO: 730557 - DNA, 13 bp, C. elegans
tggaaaaaagtgt

SEQ ID NO: 730558 - DNA, 13 bp, C. elegans
tggaaaaaatagg

SEQ ID NO: 730559 - DNA, 13 bp, C. elegans
tggaaaaaatgcg

SEQ ID NO: 730560 - DNA, 13 bp, C. elegans
tggaaaaaatgtt

SEQ ID NO: 730561 - DNA, 13 bp, C. elegans
tggaaaaacatgt

SEQ ID NO: 730562 - DNA, 13 bp, C. elegans
tggaaaaactaaa

SEQ ID NO: 730563 - DNA, 13 bp, C. elegans
tggaaaaagaaca

SEQ ID NO: 730564 - DNA, 13 bp, C. elegans
tggaaaaagagca

SEQ ID NO: 730565 - DNA, 13 bp, C. elegans
tggaaaaagtgaa

SEQ ID NO: 730566 - DNA, 13 bp, C. elegans
tggaaaaataact

SEQ ID NO: 730567 - DNA, 13 bp, C. elegans
tggaaaaatacga

SEQ ID NO: 730568 - DNA, 13 bp, C. elegans
tggaaaaatatcg

SEQ ID NO: 730569 - DNA, 13 bp, C. elegans
tggaaaaatcaca

SEQ ID NO: 730570 - DNA, 13 bp, C. elegans
tggaaaaatctaa

SEQ ID NO: 730571 - DNA, 13 bp, C. elegans
tggaaaaatgcac

SEQ ID NO: 730572 - DNA, 13 bp, C. elegans
tggaaaaatggca

SEQ ID NO: 730573 - DNA, 13 bp, C. elegans
tggaaaaatgtaa

SEQ ID NO: 730574 - DNA, 13 bp, C. elegans
tggaaaaattaat

SEQ ID NO: 730575 - DNA, 13 bp, C. elegans
tggaaaaattatt

SEQ ID NO: 730576 - DNA, 13 bp, C. elegans
tggaaaaattcga

SEQ ID NO: 730577 - DNA, 13 bp, C. elegans
tggaaaaattctg

SEQ ID NO: 730578 - DNA, 13 bp, C. elegans
tggaaaaattgga

SEQ ID NO: 730579 - DNA, 13 bp, C. elegans
tggaaaaattgtg

SEQ ID NO: 730580 - DNA, 13 bp, C. elegans
tggaaaacaagaa

SEQ ID NO: 730581 - DNA, 13 bp, C. elegans
tggaaaacatttt

SEQ ID NO: 730582 - DNA, 13 bp, C. elegans
tggaaaaccaaaa

SEQ ID NO: 730583 - DNA, 13 bp, C. elegans
tggaaaaccacaa

SEQ ID NO: 730584 - DNA, 13 bp, C. elegans
tggaaaaccgaaa

SEQ ID NO: 730585 - DNA, 13 bp, C. elegans
tggaaaaccggca

SEQ ID NO: 730586 - DNA, 13 bp, C. elegans
tggaaaacgattt

SEQ ID NO: 730587 - DNA, 13 bp, C. elegans
tggaaaacggaaa

SEQ ID NO: 730588 - DNA, 13 bp, C. elegans
tggaaaacggtca

SEQ ID NO: 730589 - DNA, 13 bp, C. elegans
tggaaaactaata

SEQ ID NO: 730590 - DNA, 13 bp, C. elegans
tggaaaactgaaa

SEQ ID NO: 730591 - DNA, 13 bp, C. elegans
tggaaaacttgat

SEQ ID NO: 730592 - DNA, 13 bp, C. elegans
tggaaaagctcaa

SEQ ID NO: 730593 - DNA, 13 bp, C. elegans
tggaaaaggaaat

SEQ ID NO: 730594 - DNA, 13 bp, C. elegans
tggaaaagtggct

SEQ ID NO: 730595 - DNA, 13 bp, C. elegans
tggaaaagtgtga

SEQ ID NO: 730596 - DNA, 13 bp, C. elegans
tggaaaagtgtta

SEQ ID NO: 730597 - DNA, 13 bp, C. elegans
tggaaaagttcaa

SEQ ID NO: 730598 - DNA, 13 bp, C. elegans
tggaaaagttgat

SEQ ID NO: 730599 - DNA, 13 bp, C. elegans
tggaaaagtttaa

SEQ ID NO: 730600 - DNA, 13 bp, C. elegans
tggaaaatactaa

SEQ ID NO: 730601 - DNA, 13 bp, C. elegans
tggaaaatagtat

SEQ ID NO: 730602 - DNA, 13 bp, C. elegans
tggaaaatatact

SEQ ID NO: 730603 - DNA, 13 bp, C. elegans
tggaaaatatatt

SEQ ID NO: 730604 - DNA, 13 bp, C. elegans
tggaaaatatttt

SEQ ID NO: 730605 - DNA, 13 bp, C. elegans
tggaaaatcaaga

SEQ ID NO: 730606 - DNA, 13 bp, C. elegans
tggaaaatcacaa

SEQ ID NO: 730607 - DNA, 13 bp, C. elegans
tggaaaatccaat

SEQ ID NO: 730608 - DNA, 13 bp, C. elegans
tggaaaatcgatt

SEQ ID NO: 730609 - DNA, 13 bp, C. elegans
tggaaaatctgaa

SEQ ID NO: 730610 - DNA, 13 bp, C. elegans
tggaaaatctgga

SEQ ID NO: 730611 - DNA, 13 bp, C. elegans
tggaaaatgaata

SEQ ID NO: 730612 - DNA, 13 bp, C. elegans
tggaaaatgagaa

SEQ ID NO: 730613 - DNA, 13 bp, C. elegans
tggaaaatgatga

SEQ ID NO: 730614 - DNA, 13 bp, C. elegans
tggaaaatgcttt

SEQ ID NO: 730615 - DNA, 13 bp, C. elegans
tggaaaatgtagt

SEQ ID NO: 730616 - DNA, 13 bp, C. elegans
tggaaaatgtgga

SEQ ID NO: 730617 - DNA, 13 bp, C. elegans
tggaaaatgtttc

SEQ ID NO: 730618 - DNA, 13 bp, C. elegans
tggaaaattatca

SEQ ID NO: 730619 - DNA, 13 bp, C. elegans
tggaaaattatta

SEQ ID NO: 730620 - DNA, 13 bp, C. elegans
tggaaaattcagt

SEQ ID NO: 730621 - DNA, 13 bp, C. elegans
tggaaaattcata

SEQ ID NO: 730622 - DNA, 13 bp, C. elegans
tggaaaattctga

SEQ ID NO: 730623 - DNA, 13 bp, C. elegans
tggaaaattgaaa

SEQ ID NO: 730624 - DNA, 13 bp, C. elegans
tggaaaattgctc

SEQ ID NO: 730625 - DNA, 13 bp, C. elegans
tggaaaattgctt

SEQ ID NO: 730626 - DNA, 13 bp, C. elegans
tggaaaattggct

SEQ ID NO: 730627 - DNA, 13 bp, C. elegans
tggaaaattggga

SEQ ID NO: 730628 - DNA, 13 bp, C. elegans
tggaaaattggtt

SEQ ID NO: 730629 - DNA, 13 bp, C. elegans
tggaaaatttcgg

SEQ ID NO: 730630 - DNA, 13 bp, C. elegans
tggaaaatttgaa

SEQ ID NO: 730631 - DNA, 13 bp, C. elegans
tggaaaattttgg

SEQ ID NO: 730632 - DNA, 13 bp, C. elegans
tggaaacaaaata

SEQ ID NO: 730633 - DNA, 13 bp, C. elegans
tggaaacaatttt

SEQ ID NO: 730634 - DNA, 13 bp, C. elegans
tggaaacactttt

SEQ ID NO: 730635 - DNA, 13 bp, C. elegans
tggaaacattaaa

SEQ ID NO: 730636 - DNA, 13 bp, C. elegans
tggaaacattgaa

SEQ ID NO: 730637 - DNA, 13 bp, C. elegans
tggaaacatttta

SEQ ID NO: 730638 - DNA, 13 bp, C. elegans
tggaaacattttg

SEQ ID NO: 730639 - DNA, 13 bp, C. elegans
tggaaacattttt

SEQ ID NO: 730640 - DNA, 13 bp, C. elegans
tggaaacctcaaa

SEQ ID NO: 730641 - DNA, 13 bp, C. elegans
tggaaactaactt

SEQ ID NO: 730642 - DNA, 13 bp, C. elegans
tggaaactatttt

SEQ ID NO: 730643 - DNA, 13 bp, C. elegans
tggaaactttcag

SEQ ID NO: 730644 - DNA, 13 bp, C. elegans
tggaaacttttag

SEQ ID NO: 730645 - DNA, 13 bp, C. elegans
tggaaacttttta

SEQ ID NO: 730646 - DNA, 13 bp, C. elegans
tggaaactttttt

SEQ ID NO: 730647 - DNA, 13 bp, C. elegans
tggaaagaaaaca

SEQ ID NO: 730648 - DNA, 13 bp, C. elegans
tggaaagctgaaa

SEQ ID NO: 730649 - DNA, 13 bp, C. elegans
tggaaagtcaaaa

SEQ ID NO: 730650 - DNA, 13 bp, C. elegans
tggaaagtctaga

SEQ ID NO: 730651 - DNA, 13 bp, C. elegans
tggaaagttaaaa

SEQ ID NO: 730652 - DNA, 13 bp, C. elegans
tggaaagtttttg

SEQ ID NO: 730653 - DNA, 13 bp, C. elegans
tggaaataaaatg

SEQ ID NO: 730654 - DNA, 13 bp, C. elegans
tggaaataaaatt

SEQ ID NO: 730655 - DNA, 13 bp, C. elegans
tggaaataataat

SEQ ID NO: 730656 - DNA, 13 bp, C. elegans
tggaaataatatt

SEQ ID NO: 730657 - DNA, 13 bp, C. elegans
tggaaataatgaa

SEQ ID NO: 730658 - DNA, 13 bp, C. elegans
tggaaataatgga

SEQ ID NO: 730659 - DNA, 13 bp, C. elegans
tggaaataattgt

SEQ ID NO: 730660 - DNA, 13 bp, C. elegans
tggaaataatttt

SEQ ID NO: 730661 - DNA, 13 bp, C. elegans
tggaaatacaaaa

SEQ ID NO: 730662 - DNA, 13 bp, C. elegans
tggaaatataatt

SEQ ID NO: 730663 - DNA, 13 bp, C. elegans
tggaaatatggaa

SEQ ID NO: 730664 - DNA, 13 bp, C. elegans
tggaaatattatt

SEQ ID NO: 730665 - DNA, 13 bp, C. elegans
tggaaatattgat

SEQ ID NO: 730666 - DNA, 13 bp, C. elegans
tggaaatatttaa

SEQ ID NO: 730667 - DNA, 13 bp, C. elegans
tggaaatatttca

SEQ ID NO: 730668 - DNA, 13 bp, C. elegans
tggaaatatttga

SEQ ID NO: 730669 - DNA, 13 bp, C. elegans
tggaaatattttt

SEQ ID NO: 730670 - DNA, 13 bp, C. elegans
tggaaatcaaaaa

SEQ ID NO: 730671 - DNA, 13 bp, C. elegans
tggaaatcaaaat

SEQ ID NO: 730672 - DNA, 13 bp, C. elegans
tggaaatcgaaaa

SEQ ID NO: 730673 - DNA, 13 bp, C. elegans
tggaaatcgagaa

SEQ ID NO: 730674 - DNA, 13 bp, C. elegans
tggaaatcttttt

SEQ ID NO: 730675 - DNA, 13 bp, C. elegans
tggaaatgacacc

SEQ ID NO: 730676 - DNA, 13 bp, C. elegans
tggaaatggaaat

SEQ ID NO: 730677 - DNA, 13 bp, C. elegans
tggaaatgttgga

SEQ ID NO: 730678 - DNA, 13 bp, C. elegans
tggaaattaaata

SEQ ID NO: 730679 - DNA, 13 bp, C. elegans
tggaaattaagaa

SEQ ID NO: 730680 - DNA, 13 bp, C. elegans
tggaaattaattt

SEQ ID NO: 730681 - DNA, 13 bp, C. elegans
tggaaattattat

SEQ ID NO: 730682 - DNA, 13 bp, C. elegans
tggaaattattga

SEQ ID NO: 730683 - DNA, 13 bp, C. elegans
tggaaattatttt

SEQ ID NO: 730684 - DNA, 14 bp, C. elegans
tggaaattcaaaaa

SEQ ID NO: 730685 - DNA, 13 bp, C. elegans
tggaaattcaatt

SEQ ID NO: 730686 - DNA, 13 bp, C. elegans
tggaaattcatct

SEQ ID NO: 730687 - DNA, 13 bp, C. elegans
tggaaattccgaa

SEQ ID NO: 730688 - DNA, 13 bp, C. elegans
tggaaattcttga

SEQ ID NO: 730689 - DNA, 13 bp, C. elegans
tggaaattcttgt

SEQ ID NO: 730690 - DNA, 13 bp, C. elegans
tggaaattgaaaa

SEQ ID NO: 730691 - DNA, 13 bp, C. elegans
tggaaattgaaat

SEQ ID NO: 730692 - DNA, 13 bp, C. elegans
tggaaattgagaa

SEQ ID NO: 730693 - DNA, 13 bp, C. elegans
tggaaattgagtt

SEQ ID NO: 730694 - DNA, 13 bp, C. elegans
tggaaattggaaa

SEQ ID NO: 730695 - DNA, 13 bp, C. elegans
tggaaattgggaa

SEQ ID NO: 730696 - DNA, 13 bp, C. elegans
tggaaattgtgat

SEQ ID NO: 730697 - DNA, 13 bp, C. elegans
tggaaattgtgta

SEQ ID NO: 730698 - DNA, 13 bp, C. elegans
tggaaattgtgtg

SEQ ID NO: 730699 - DNA, 13 bp, C. elegans
tggaaattgttgg

SEQ ID NO: 730700 - DNA, 13 bp, C. elegans
tggaaattgttta

SEQ ID NO: 730701 - DNA, 13 bp, C. elegans
tggaaattgtttt

SEQ ID NO: 730702 - DNA, 13 bp, C. elegans
tggaaatttaatt

SEQ ID NO: 730703 - DNA, 13 bp, C. elegans
tggaaatttacca

SEQ ID NO: 730704 - DNA, 13 bp, C. elegans
tggaaatttcgaa

SEQ ID NO: 730705 - DNA, 13 bp, C. elegans
tggaaatttcgtt

SEQ ID NO: 730706 - DNA, 13 bp, C. elegans
tggaaatttctgg

SEQ ID NO: 730707 - DNA, 13 bp, C. elegans
tggaaatttcttt

SEQ ID NO: 730708 - DNA, 13 bp, C. elegans
tggaaatttgcaa

SEQ ID NO: 730709 - DNA, 13 bp, C. elegans
tggaaatttgccg

SEQ ID NO: 730710 - DNA, 13 bp, C. elegans
tggaaatttgtga

SEQ ID NO: 730711 - DNA, 13 bp, C. elegans
tggaaattttaaa

SEQ ID NO: 730712 - DNA, 13 bp, C. elegans
tggaaattttaat

SEQ ID NO: 730713 - DNA, 13 bp, C. elegans
tggaaattttcaa

SEQ ID NO: 730714 - DNA, 13 bp, C. elegans
tggaaattttcct

SEQ ID NO: 730715 - DNA, 13 bp, C. elegans
tggaaattttcgg

SEQ ID NO: 730716 - DNA, 13 bp, C. elegans
tggaaattttcta

SEQ ID NO: 730717 - DNA, 13 bp, C. elegans
tggaaattttgga

SEQ ID NO: 730718 - DNA, 13 bp, C. elegans
tggaaattttgta

SEQ ID NO: 730719 - DNA, 13 bp, C. elegans
tggaaatttttaa

SEQ ID NO: 730720 - DNA, 13 bp, C. elegans
tggaaatttttat

SEQ ID NO: 730721 - DNA, 13 bp, C. elegans
tggaaatttttta

SEQ ID NO: 730722 - DNA, 13 bp, C. elegans
tggaacaattgaa

SEQ ID NO: 730723 - DNA, 13 bp, C. elegans
tggaacaattttt

SEQ ID NO: 730724 - DNA, 13 bp, C. elegans
tggaacacatttt

SEQ ID NO: 730725 - DNA, 13 bp, C. elegans
tggaacactttca

SEQ ID NO: 730726 - DNA, 13 bp, C. elegans
tggaacagttttg

SEQ ID NO: 730727 - DNA, 13 bp, C. elegans
tggaacattgcag

SEQ ID NO: 730728 - DNA, 13 bp, C. elegans
tggaacattttca

SEQ ID NO: 730729 - DNA, 13 bp, C. elegans
tggaacattttgg

SEQ ID NO: 730730 - DNA, 13 bp, C. elegans
tggaacatttttg

SEQ ID NO: 730731 - DNA, 13 bp, C. elegans
tggaaccaattga

SEQ ID NO: 730732 - DNA, 13 bp, C. elegans
tggaactatttct

SEQ ID NO: 730733 - DNA, 13 bp, C. elegans
tggaactattttt

SEQ ID NO: 730734 - DNA, 13 bp, C. elegans
tggaactgttttt

SEQ ID NO: 730735 - DNA, 13 bp, C. elegans
tggaactttttat

SEQ ID NO: 730736 - DNA, 13 bp, C. elegans
tggaagaaaatga

SEQ ID NO: 730737 - DNA, 14 bp, C. elegans
tggaagaaaattga

SEQ ID NO: 730738 - DNA, 13 bp, C. elegans
tggaagaaatatt

SEQ ID NO: 730739 - DNA, 13 bp, C. elegans
tggaagaaatttt

SEQ ID NO: 730740 - DNA, 13 bp, C. elegans
tggaagaatgaaa

SEQ ID NO: 730741 - DNA, 13 bp, C. elegans
tggaagagaaatg

SEQ ID NO: 730742 - DNA, 15 bp, C. elegans
tggaagaggtggccg

SEQ ID NO: 730743 - DNA, 13 bp, C. elegans
tggaagatcagat

SEQ ID NO: 730744 - DNA, 13 bp, C. elegans
tggaagccctact

SEQ ID NO: 730745 - DNA, 13 bp, C. elegans
tggaagcttctgg

SEQ ID NO: 730746 - DNA, 13 bp, C. elegans
tggaagtcgtcga

SEQ ID NO: 730747 - DNA, 13 bp, C. elegans
tggaagtttggaa

SEQ ID NO: 730748 - DNA, 13 bp, C. elegans
tggaagttttgaa

SEQ ID NO: 730749 - DNA, 13 bp, C. elegans
tggaataaatgaa

SEQ ID NO: 730750 - DNA, 13 bp, C. elegans
tggaataaatgtt

SEQ ID NO: 730751 - DNA, 13 bp, C. elegans
tggaataaattca

SEQ ID NO: 730752 - DNA, 13 bp, C. elegans
tggaataatattt

SEQ ID NO: 730753 - DNA, 13 bp, C. elegans
tggaataattaaa

SEQ ID NO: 730754 - DNA, 13 bp, C. elegans
tggaataattgaa

SEQ ID NO: 730755 - DNA, 13 bp, C. elegans
tggaataatttga

SEQ ID NO: 730756 - DNA, 13 bp, C. elegans
tggaatagaaaat

SEQ ID NO: 730757 - DNA, 13 bp, C. elegans
tggaatagcgcca

SEQ ID NO: 730758 - DNA, 13 bp, C. elegans
tggaatagttttg

SEQ ID NO: 730759 - DNA, 13 bp, C. elegans
tggaatatcaaat

SEQ ID NO: 730760 - DNA, 13 bp, C. elegans
tggaatatggtcg

SEQ ID NO: 730761 - DNA, 13 bp, C. elegans
tggaatattaatt

SEQ ID NO: 730762 - DNA, 13 bp, C. elegans
tggaatattcgtg

SEQ ID NO: 730763 - DNA, 13 bp, C. elegans
tggaatattggaa

SEQ ID NO: 730764 - DNA, 13 bp, C. elegans
tggaatatttgaa

SEQ ID NO: 730765 - DNA, 13 bp, C. elegans
tggaatatttgga

SEQ ID NO: 730766 - DNA, 13 bp, C. elegans
tggaatcaaaaag

SEQ ID NO: 730767 - DNA, 13 bp, C. elegans
tggaatcaaacat

SEQ ID NO: 730768 - DNA, 13 bp, C. elegans
tggaatgttctag

SEQ ID NO: 730769 - DNA, 13 bp, C. elegans
tggaatgtttgaa

SEQ ID NO: 730770 - DNA, 13 bp, C. elegans
tggaattatcatc

SEQ ID NO: 730771 - DNA, 13 bp, C. elegans
tggaattcaaaaa

SEQ ID NO: 730772 - DNA, 13 bp, C. elegans
tggaattcaaatt

SEQ ID NO: 730773 - DNA, 13 bp, C. elegans
tggaattccaaaa

SEQ ID NO: 730774 - DNA, 13 bp, C. elegans
tggaattcgacac

SEQ ID NO: 730775 - DNA, 13 bp, C. elegans
tggaattcgattt

SEQ ID NO: 730776 - DNA, 13 bp, C. elegans
tggaattctgaaa

SEQ ID NO: 730777 - DNA, 13 bp, C. elegans
tggaattcttatt

SEQ ID NO: 730778 - DNA, 13 bp, C. elegans
tggaattgaaatt

SEQ ID NO: 730779 - DNA, 13 bp, C. elegans
tggaattgaacat

SEQ ID NO: 730780 - DNA, 13 bp, C. elegans
tggaattggaatt

SEQ ID NO: 730781 - DNA, 13 bp, C. elegans
tggaattgtttca

SEQ ID NO: 730782 - DNA, 13 bp, C. elegans
tggaatttatttg

SEQ ID NO: 730783 - DNA, 13 bp, C. elegans
tggaatttcaaaa

SEQ ID NO: 730784 - DNA, 13 bp, C. elegans
tggaatttcaatt

SEQ ID NO: 730785 - DNA, 13 bp, C. elegans
tggaatttcagag

SEQ ID NO: 730786 - DNA, 13 bp, C. elegans
tggaatttcagat

SEQ ID NO: 730787 - DNA, 13 bp, C. elegans
tggaatttcagca

SEQ ID NO: 730788 - DNA, 13 bp, C. elegans
tggaatttccaat

SEQ ID NO: 730789 - DNA, 13 bp, C. elegans
tggaatttcgaga

SEQ ID NO: 730790 - DNA, 13 bp, C. elegans
tggaatttcttca

SEQ ID NO: 730791 - DNA, 13 bp, C. elegans
tggaatttgaaaa

SEQ ID NO: 730792 - DNA, 13 bp, C. elegans
tggaatttgaaat

SEQ ID NO: 730793 - DNA, 13 bp, C. elegans
tggaatttgtaaa

SEQ ID NO: 730794 - DNA, 13 bp, C. elegans
tggaatttgtaga

SEQ ID NO: 730795 - DNA, 13 bp, C. elegans
tggaattttcacc

SEQ ID NO: 730796 - DNA, 13 bp, C. elegans
tggaattttcgga

SEQ ID NO: 730797 - DNA, 13 bp, C. elegans
tggaattttctag

SEQ ID NO: 730798 - DNA, 13 bp, C. elegans
tggaattttctgg

SEQ ID NO: 730799 - DNA, 13 bp, C. elegans
tggaattttgaga

SEQ ID NO: 730800 - DNA, 13 bp, C. elegans
tggaattttggac

SEQ ID NO: 730801 - DNA, 13 bp, C. elegans
tggaattttggga

SEQ ID NO: 730802 - DNA, 13 bp, C. elegans
tggaattttgttg

SEQ ID NO: 730803 - DNA, 13 bp, C. elegans
tggaatttttccc

SEQ ID NO: 730804 - DNA, 13 bp, C. elegans
tggaatttttgaa

SEQ ID NO: 730805 - DNA, 13 bp, C. elegans
tggaatttttgag

SEQ ID NO: 730806 - DNA, 13 bp, C. elegans
tggaatttttgga

SEQ ID NO: 730807 - DNA, 13 bp, C. elegans
tggaattttttaa

SEQ ID NO: 730808 - DNA, 13 bp, C. elegans
tggacaacatttt

SEQ ID NO: 730809 - DNA, 13 bp, C. elegans
tggacaatatgga

SEQ ID NO: 730810 - DNA, 13 bp, C. elegans
tggacaatatttt

SEQ ID NO: 730811 - DNA, 13 bp, C. elegans
tggacaatttttc

SEQ ID NO: 730812 - DNA, 13 bp, C. elegans
tggaccattttaa

SEQ ID NO: 730813 - DNA, 13 bp, C. elegans
tggacgataaaaa

SEQ ID NO: 730814 - DNA, 13 bp, C. elegans
tggactacggtag

SEQ ID NO: 730815 - DNA, 13 bp, C. elegans
tggactttttgga

SEQ ID NO: 730816 - DNA, 13 bp, C. elegans
tggagaaaaaatc

SEQ ID NO: 730817 - DNA, 13 bp, C. elegans
tggagaaaaatgg

SEQ ID NO: 730818 - DNA, 13 bp, C. elegans
tggagaaaaattg

SEQ ID NO: 730819 - DNA, 13 bp, C. elegans
tggagaaacaaaa

SEQ ID NO: 730820 - DNA, 13 bp, C. elegans
tggagaaagatat

SEQ ID NO: 730821 - DNA, 13 bp, C. elegans
tggagaaatattt

SEQ ID NO: 730822 - DNA, 13 bp, C. elegans
tggagaaattaat

SEQ ID NO: 730823 - DNA, 13 bp, C. elegans
tggagaacaaaac

SEQ ID NO: 730824 - DNA, 13 bp, C. elegans
tggagaagaagca

SEQ ID NO: 730825 - DNA, 13 bp, C. elegans
tggagaatatgga

SEQ ID NO: 730826 - DNA, 13 bp, C. elegans
tggagaattcgaa

SEQ ID NO: 730827 - DNA, 13 bp, C. elegans
tggagaattgaaa

SEQ ID NO: 730828 - DNA, 13 bp, C. elegans
tggagaatttcaa

SEQ ID NO: 730829 - DNA, 13 bp, C. elegans
tggagagttcagt

SEQ ID NO: 730830 - DNA, 13 bp, C. elegans
tggagatgagaag

SEQ ID NO: 730831 - DNA, 13 bp, C. elegans
tggagatgcagca

SEQ ID NO: 730832 - DNA, 13 bp, C. elegans
tggagatggacag

SEQ ID NO: 730833 - DNA, 13 bp, C. elegans
tggagattcttta

SEQ ID NO: 730834 - DNA, 13 bp, C. elegans
tggagcacaaaaa

SEQ ID NO: 730835 - DNA, 13 bp, C. elegans
tggagcaccaaaa

SEQ ID NO: 730836 - DNA, 13 bp, C. elegans
tggagcaccaaat

SEQ ID NO: 730837 - DNA, 13 bp, C. elegans
tggagcagcaaca

SEQ ID NO: 730838 - DNA, 13 bp, C. elegans
tggagcattttta

SEQ ID NO: 730839 - DNA, 13 bp, C. elegans
tggagcgcaaaaa

SEQ ID NO: 730840 - DNA, 13 bp, C. elegans
tggagcgcgttta

SEQ ID NO: 730841 - DNA, 13 bp, C. elegans
tggagcggccgac

SEQ ID NO: 730842 - DNA, 13 bp, C. elegans
tggagctctgaaa

SEQ ID NO: 730843 - DNA, 13 bp, C. elegans
tggagcttctttt

SEQ ID NO: 730844 - DNA, 13 bp, C. elegans
tggaggaaaattg

SEQ ID NO: 730845 - DNA, 13 bp, C. elegans
tggaggataatgt

SEQ ID NO: 730846 - DNA, 13 bp, C. elegans
tggagtacacaac

SEQ ID NO: 730847 - DNA, 13 bp, C. elegans
tggagtttcaatt

SEQ ID NO: 730848 - DNA, 13 bp, C. elegans
tggagtttttctt

SEQ ID NO: 730849 - DNA, 13 bp, C. elegans
tggagtttttgta

SEQ ID NO: 730850 - DNA, 13 bp, C. elegans
tggataatgaatg

SEQ ID NO: 730851 - DNA, 13 bp, C. elegans
tggatacaacaca

SEQ ID NO: 730852 - DNA, 13 bp, C. elegans
tggatactttgtc

SEQ ID NO: 730853 - DNA, 13 bp, C. elegans
tggatagaaatga

SEQ ID NO: 730854 - DNA, 13 bp, C. elegans
tggatatgaatgc

SEQ ID NO: 730855 - DNA, 13 bp, C. elegans
tggatatttaaaa

SEQ ID NO: 730856 - DNA, 13 bp, C. elegans
tggatattttaaa

SEQ ID NO: 730857 - DNA, 13 bp, C. elegans
tggatattttcag

SEQ ID NO: 730858 - DNA, 13 bp, C. elegans
tggatatttttga

SEQ ID NO: 730859 - DNA, 13 bp, C. elegans
tggatcataataa

SEQ ID NO: 730860 - DNA, 15 bp, C. elegans
tggatcgcaacatcc

SEQ ID NO: 730861 - DNA, 15 bp, C. elegans
tggatcggaatggat

SEQ ID NO: 730862 - DNA, 13 bp, C. elegans
tggatctgaaaat

SEQ ID NO: 730863 - DNA, 13 bp, C. elegans
tggatcttcgaaa

SEQ ID NO: 730864 - DNA, 13 bp, C. elegans
tggatgaaaatga

SEQ ID NO: 730865 - DNA, 13 bp, C. elegans
tggatgaaatgaa

SEQ ID NO: 730866 - DNA, 13 bp, C. elegans
tggatggatggat

SEQ ID NO: 730867 - DNA, 13 bp, C. elegans
tggatggatgttg

SEQ ID NO: 730868 - DNA, 13 bp, C. elegans
tggatgggtctcg

SEQ ID NO: 730869 - DNA, 13 bp, C. elegans
tggatgtattctt

SEQ ID NO: 730870 - DNA, 13 bp, C. elegans
tggatgttttgga

SEQ ID NO: 730871 - DNA, 13 bp, C. elegans
tggattacggtag

SEQ ID NO: 730872 - DNA, 13 bp, C. elegans
tggattactgtag

SEQ ID NO: 730873 - DNA, 13 bp, C. elegans
tggattattgatt

SEQ ID NO: 730874 - DNA, 13 bp, C. elegans
tggattcaaaatt

SEQ ID NO: 730875 - DNA, 13 bp, C. elegans
tggattcaatttt

SEQ ID NO: 730876 - DNA, 13 bp, C. elegans
tggatttaaaaaa

SEQ ID NO: 730877 - DNA, 13 bp, C. elegans
tggatttacggag

SEQ ID NO: 730878 - DNA, 13 bp, C. elegans
tggatttcaattt

SEQ ID NO: 730879 - DNA, 13 bp, C. elegans
tggatttcatatt

SEQ ID NO: 730880 - DNA, 13 bp, C. elegans
tggatttccttaa

SEQ ID NO: 730881 - DNA, 13 bp, C. elegans
tggatttctaggc

SEQ ID NO: 730882 - DNA, 13 bp, C. elegans
tggatttcttcaa

SEQ ID NO: 730883 - DNA, 13 bp, C. elegans
tggatttgttcga

SEQ ID NO: 730884 - DNA, 13 bp, C. elegans
tggatttgttcgg

SEQ ID NO: 730885 - DNA, 13 bp, C. elegans
tggattttattga

SEQ ID NO: 730886 - DNA, 13 bp, C. elegans
tggattttcagaa

SEQ ID NO: 730887 - DNA, 13 bp, C. elegans
tggattttcgaaa

SEQ ID NO: 730888 - DNA, 13 bp, C. elegans
tggattttcttga

SEQ ID NO: 730889 - DNA, 13 bp, C. elegans
tggattttggtat

SEQ ID NO: 730890 - DNA, 13 bp, C. elegans
tggatttttaata

SEQ ID NO: 730891 - DNA, 13 bp, C. elegans
tggatttttcaat

SEQ ID NO: 730892 - DNA, 13 bp, C. elegans
tggatttttgtaa

SEQ ID NO: 730893 - DNA, 13 bp, C. elegans
tggattttttaaa

SEQ ID NO: 730894 - DNA, 13 bp, C. elegans
tggcaaaaaatat

SEQ ID NO: 730895 - DNA, 13 bp, C. elegans
tggcaaaaactaa

SEQ ID NO: 730896 - DNA, 13 bp, C. elegans
tggcaaaaactgt

SEQ ID NO: 730897 - DNA, 13 bp, C. elegans
tggcaaaaatgga

SEQ ID NO: 730898 - DNA, 13 bp, C. elegans
tggcaaaaatgtt

SEQ ID NO: 730899 - DNA, 13 bp, C. elegans
tggcaaaatgccg

SEQ ID NO: 730900 - DNA, 13 bp, C. elegans
tggcaaaatttaa

SEQ ID NO: 730901 - DNA, 13 bp, C. elegans
tggcaaagtgcca

SEQ ID NO: 730902 - DNA, 13 bp, C. elegans
tggcaaagttttg

SEQ ID NO: 730903 - DNA, 13 bp, C. elegans
tggcaaattttca

SEQ ID NO: 730904 - DNA, 13 bp, C. elegans
tggcaagaaaatg

SEQ ID NO: 730905 - DNA, 13 bp, C. elegans
tggcaagaagtca

SEQ ID NO: 730906 - DNA, 13 bp, C. elegans
tggcaagttgcca

SEQ ID NO: 730907 - DNA, 13 bp, C. elegans
tggcaataaaaat

SEQ ID NO: 730908 - DNA, 13 bp, C. elegans
tggcaattattca

SEQ ID NO: 730909 - DNA, 13 bp, C. elegans
tggcaattgtttt

SEQ ID NO: 730910 - DNA, 13 bp, C. elegans
tggcaatttccaa

SEQ ID NO: 730911 - DNA, 13 bp, C. elegans
tggcaatttggca

SEQ ID NO: 730912 - DNA, 13 bp, C. elegans
tggcaatttttga

SEQ ID NO: 730913 - DNA, 13 bp, C. elegans
tggcacaaaattg

SEQ ID NO: 730914 - DNA, 13 bp, C. elegans
tggcaccgtgcca

SEQ ID NO: 730915 - DNA, 13 bp, C. elegans
tggcacgatgcca

SEQ ID NO: 730916 - DNA, 13 bp, C. elegans
tggcacggtgcca

SEQ ID NO: 730917 - DNA, 13 bp, C. elegans
tggcactgtgcca

SEQ ID NO: 730918 - DNA, 33 bp, C. elegans
tggcacttattcgtcttgctcggccgactcata

SEQ ID NO: 730919 - DNA, 13 bp, C. elegans
tggcactttttga

SEQ ID NO: 730920 - DNA, 13 bp, C. elegans
tggcagagtattt

SEQ ID NO: 730921 - DNA, 13 bp, C. elegans
tggcataattttt

SEQ ID NO: 730922 - DNA, 13 bp, C. elegans
tggcataccaaaa

SEQ ID NO: 730923 - DNA, 13 bp, C. elegans
tggcatatgtttt

SEQ ID NO: 730924 - DNA, 13 bp, C. elegans
tggcatcgtgcca

SEQ ID NO: 730925 - DNA, 13 bp, C. elegans
tggcatctgcaaa

SEQ ID NO: 730926 - DNA, 13 bp, C. elegans
tggcattaatttt

SEQ ID NO: 730927 - DNA, 13 bp, C. elegans
tggcattttttaa

SEQ ID NO: 730928 - DNA, 13 bp, C. elegans
tggccaaaaaaat

SEQ ID NO: 730929 - DNA, 13 bp, C. elegans
tggccaaaaagat

SEQ ID NO: 730930 - DNA, 13 bp, C. elegans
tggccaaacttgg

SEQ ID NO: 730931 - DNA, 13 bp, C. elegans
tggccacgcccat

SEQ ID NO: 730932 - DNA, 13 bp, C. elegans
tggcccgtttttc

SEQ ID NO: 730933 - DNA, 13 bp, C. elegans
tggccgagtggtt

SEQ ID NO: 730934 - DNA, 13 bp, C. elegans
tggccgagttttc

SEQ ID NO: 730935 - DNA, 13 bp, C. elegans
tggccgagttttg

SEQ ID NO: 730936 - DNA, 13 bp, C. elegans
tggccgtggccga

SEQ ID NO: 730937 - DNA, 13 bp, C. elegans
tggccgtggccta

SEQ ID NO: 730938 - DNA, 13 bp, C. elegans
tggcctaactttt

SEQ ID NO: 730939 - DNA, 13 bp, C. elegans
tggcctacgccta

SEQ ID NO: 730940 - DNA, 13 bp, C. elegans
tggcgaaaatcga

SEQ ID NO: 730941 - DNA, 13 bp, C. elegans
tggcgaatcggca

SEQ ID NO: 730942 - DNA, 13 bp, C. elegans
tggcgatgtgttg

SEQ ID NO: 730943 - DNA, 13 bp, C. elegans
tggcgattcaaaa

SEQ ID NO: 730944 - DNA, 13 bp, C. elegans
tggcggaaaaatc

SEQ ID NO: 730945 - DNA, 13 bp, C. elegans
tggcggagggcca

SEQ ID NO: 730946 - DNA, 13 bp, C. elegans
tggcggtcgtttg

SEQ ID NO: 730947 - DNA, 13 bp, C. elegans
tggctcaaaaatt

SEQ ID NO: 730948 - DNA, 13 bp, C. elegans
tggctcagtggct

SEQ ID NO: 730949 - DNA, 13 bp, C. elegans
tggctcagtggga

SEQ ID NO: 730950 - DNA, 13 bp, C. elegans
tggctccgcccat

SEQ ID NO: 730951 - DNA, 13 bp, C. elegans
tggctgaaattct

SEQ ID NO: 730952 - DNA, 13 bp, C. elegans
tggctggaatttt

SEQ ID NO: 730953 - DNA, 19 bp, C. elegans
tggctgtccttttgcataa

SEQ ID NO: 730954 - DNA, 13 bp, C. elegans
tggctttcaaaaa

SEQ ID NO: 730955 - DNA, 13 bp, C. elegans
tgggaaaaaacaa

SEQ ID NO: 730956 - DNA, 13 bp, C. elegans
tgggaaaaatgtt

SEQ ID NO: 730957 - DNA, 13 bp, C. elegans
tgggaaaaattga

SEQ ID NO: 730958 - DNA, 13 bp, C. elegans
tgggaaaacaatt

SEQ ID NO: 730959 - DNA, 13 bp, C. elegans
tgggaaaagtgtt

SEQ ID NO: 730960 - DNA, 13 bp, C. elegans
tgggaaaatgttg

SEQ ID NO: 730961 - DNA, 13 bp, C. elegans
tgggaaaattaaa

SEQ ID NO: 730962 - DNA, 13 bp, C. elegans
tgggaaaattgaa

SEQ ID NO: 730963 - DNA, 13 bp, C. elegans
tgggaaaattgga

SEQ ID NO: 730964 - DNA, 13 bp, C. elegans
tgggaaaattgtc

SEQ ID NO: 730965 - DNA, 13 bp, C. elegans
tgggaaagttgaa

SEQ ID NO: 730966 - DNA, 13 bp, C. elegans
tgggaaatatttt

SEQ ID NO: 730967 - DNA, 13 bp, C. elegans
tgggaaatcccaa

SEQ ID NO: 730968 - DNA, 13 bp, C. elegans
tgggaaatggaaa

SEQ ID NO: 730969 - DNA, 13 bp, C. elegans
tgggaaattgctt

SEQ ID NO: 730970 - DNA, 13 bp, C. elegans
tgggaagttttca

SEQ ID NO: 730971 - DNA, 13 bp, C. elegans
tgggaatattttt

SEQ ID NO: 730972 - DNA, 13 bp, C. elegans
tgggaattatttt

SEQ ID NO: 730973 - DNA, 13 bp, C. elegans
tgggaattgtttt

SEQ ID NO: 730974 - DNA, 13 bp, C. elegans
tgggaattttcta

SEQ ID NO: 730975 - DNA, 13 bp, C. elegans
tgggacactctga

SEQ ID NO: 730976 - DNA, 13 bp, C. elegans
tgggacccaactt

SEQ ID NO: 730977 - DNA, 13 bp, C. elegans
tgggagaagtgta

SEQ ID NO: 730978 - DNA, 13 bp, C. elegans
tgggagatttttg

SEQ ID NO: 730979 - DNA, 13 bp, C. elegans
tgggattattatt

SEQ ID NO: 730980 - DNA, 13 bp, C. elegans
tgggcaaaaaaat

SEQ ID NO: 730981 - DNA, 13 bp, C. elegans
tgggcaaaacttt

SEQ ID NO: 730982 - DNA, 13 bp, C. elegans
tgggcaagaagct

SEQ ID NO: 730983 - DNA, 13 bp, C. elegans
tgggcggagccta

SEQ ID NO: 730984 - DNA, 13 bp, C. elegans
tgggcggagtcag

SEQ ID NO: 730985 - DNA, 13 bp, C. elegans
tgggctgaaaatg

SEQ ID NO: 730986 - DNA, 13 bp, C. elegans
tgggcttgaatga

SEQ ID NO: 730987 - DNA, 13 bp, C. elegans
tgggctttggctt

SEQ ID NO: 730988 - DNA, 13 bp, C. elegans
tggggaaaatttg

SEQ ID NO: 730989 - DNA, 13 bp, C. elegans
tggggaaattgtt

SEQ ID NO: 730990 - DNA, 13 bp, C. elegans
tggggatactgta

SEQ ID NO: 730991 - DNA, 13 bp, C. elegans
tggggctgaaaaa

SEQ ID NO: 730992 - DNA, 13 bp, C. elegans
tggggtactgtag

SEQ ID NO: 730993 - DNA, 13 bp, C. elegans
tgggtaagaagtt

SEQ ID NO: 730994 - DNA, 13 bp, C. elegans
tgggtactgtagc

SEQ ID NO: 730995 - DNA, 13 bp, C. elegans
tgggtcccaccgc

SEQ ID NO: 730996 - DNA, 13 bp, C. elegans
tgggtctcgcaac

SEQ ID NO: 730997 - DNA, 13 bp, C. elegans
tgggtgaaaatcg

SEQ ID NO: 730998 - DNA, 13 bp, C. elegans
tgggtgcttttcg

SEQ ID NO: 730999 - DNA, 13 bp, C. elegans
tgggtggagccta

SEQ ID NO: 731000 - DNA, 13 bp, C. elegans
tgggtggatggat

SEQ ID NO: 731001 - DNA, 14 bp, C. elegans
tgggttactgtagc

SEQ ID NO: 731002 - DNA, 13 bp, C. elegans
tgggttttcttga

SEQ ID NO: 731003 - DNA, 13 bp, C. elegans
tgggtttttgaaa

SEQ ID NO: 731004 - DNA, 13 bp, C. elegans
tggtaaattaatt

SEQ ID NO: 731005 - DNA, 13 bp, C. elegans
tggtaattttgaa

SEQ ID NO: 731006 - DNA, 13 bp, C. elegans
tggtaccgtattt

SEQ ID NO: 731007 - DNA, 13 bp, C. elegans
tggtagatcaaac

SEQ ID NO: 731008 - DNA, 13 bp, C. elegans
tggtaggaaagtt

SEQ ID NO: 731009 - DNA, 13 bp, C. elegans
tggtatatatata

SEQ ID NO: 731010 - DNA, 13 bp, C. elegans
tggtatttcttgt

SEQ ID NO: 731011 - DNA, 13 bp, C. elegans
tggtattttaaaa

SEQ ID NO: 731012 - DNA, 13 bp, C. elegans
tggtcaaaaactt

SEQ ID NO: 731013 - DNA, 13 bp, C. elegans
tggtcaattttca

SEQ ID NO: 731014 - DNA, 13 bp, C. elegans
tggtcatttttct

SEQ ID NO: 731015 - DNA, 13 bp, C. elegans
tggtccaaaattg

SEQ ID NO: 731016 - DNA, 27 bp, C. elegans
tggtccactatagccaaggaccgaaaa

SEQ ID NO: 731017 - DNA, 13 bp, C. elegans
tggtccagttttt

SEQ ID NO: 731018 - DNA, 13 bp, C. elegans
tggtcgagctgaa

SEQ ID NO: 731019 - DNA, 13 bp, C. elegans
tggtctcaaaatg

SEQ ID NO: 731020 - DNA, 13 bp, C. elegans
tggtctgctagac

SEQ ID NO: 731021 - DNA, 13 bp, C. elegans
tggtcttttttca

SEQ ID NO: 731022 - DNA, 13 bp, C. elegans
tggtgaaatattt

SEQ ID NO: 731023 - DNA, 13 bp, C. elegans
tggtgaacttttt

SEQ ID NO: 731024 - DNA, 13 bp, C. elegans
tggtgaagccaga

SEQ ID NO: 731025 - DNA, 13 bp, C. elegans
tggtgaagtttca

SEQ ID NO: 731026 - DNA, 13 bp, C. elegans
tggtgcatcgacg

SEQ ID NO: 731027 - DNA, 13 bp, C. elegans
tggtgcattttct

SEQ ID NO: 731028 - DNA, 13 bp, C. elegans
tggtgccaaaata

SEQ ID NO: 731029 - DNA, 13 bp, C. elegans
tggtgctctaccg

SEQ ID NO: 731030 - DNA, 13 bp, C. elegans
tggtggaaattga

SEQ ID NO: 731031 - DNA, 13 bp, C. elegans
tggtggccgaggt

SEQ ID NO: 731032 - DNA, 13 bp, C. elegans
tggtggcctagga

SEQ ID NO: 731033 - DNA, 13 bp, C. elegans
tggtggttcaaaa

SEQ ID NO: 731034 - DNA, 13 bp, C. elegans
tggtgtcaaaatg

SEQ ID NO: 731035 - DNA, 13 bp, C. elegans
tggtgtcaaagtg

SEQ ID NO: 731036 - DNA, 13 bp, C. elegans
tggtgtcgattta

SEQ ID NO: 731037 - DNA, 13 bp, C. elegans
tggtgtttttgac

SEQ ID NO: 731038 - DNA, 13 bp, C. elegans
tggttcaaaaaat

SEQ ID NO: 731039 - DNA, 13 bp, C. elegans
tggttcaaaagtg

SEQ ID NO: 731040 - DNA, 13 bp, C. elegans
tggttcaaaagtt

SEQ ID NO: 731041 - DNA, 13 bp, C. elegans
tggttcacgtttt

SEQ ID NO: 731042 - DNA, 13 bp, C. elegans
tggttcatatgaa

SEQ ID NO: 731043 - DNA, 13 bp, C. elegans
tggttgaaaaact

SEQ ID NO: 731044 - DNA, 13 bp, C. elegans
tggttgaaaaatg

SEQ ID NO: 731045 - DNA, 13 bp, C. elegans
tggttgccggttg

SEQ ID NO: 731046 - DNA, 13 bp, C. elegans
tggttggaagcca

SEQ ID NO: 731047 - DNA, 13 bp, C. elegans
tggtttcaaataa

SEQ ID NO: 731048 - DNA, 13 bp, C. elegans
tggtttctcattt

SEQ ID NO: 731049 - DNA, 13 bp, C. elegans
tggtttctgaaca

SEQ ID NO: 731050 - DNA, 13 bp, C. elegans
tggtttgaaagag

SEQ ID NO: 731051 - DNA, 13 bp, C. elegans
tggtttgaggtta

SEQ ID NO: 731052 - DNA, 13 bp, C. elegans
tggttttaaaaaa

SEQ ID NO: 731053 - DNA, 13 bp, C. elegans
tggttttcaaaaa

SEQ ID NO: 731054 - DNA, 13 bp, C. elegans
tggttttgcacat

SEQ ID NO: 731055 - DNA, 13 bp, C. elegans
tggttttgcagtt

SEQ ID NO: 731056 - DNA, 13 bp, C. elegans
tggttttgcattt

SEQ ID NO: 731057 - DNA, 13 bp, C. elegans
tggtttttaaaac

SEQ ID NO: 731058 - DNA, 13 bp, C. elegans
tggtttttaaaag

SEQ ID NO: 731059 - DNA, 13 bp, C. elegans
tggtttttcaata

SEQ ID NO: 731060 - DNA, 13 bp, C. elegans
tggtttttctcaa

SEQ ID NO: 731061 - DNA, 13 bp, C. elegans
tggtttttctgaa

SEQ ID NO: 731062 - DNA, 13 bp, C. elegans
tggtttttgaaac

SEQ ID NO: 731063 - DNA, 13 bp, C. elegans
tggtttttgaaat

SEQ ID NO: 731064 - DNA, 13 bp, C. elegans
tggtttttgcaaa

SEQ ID NO: 731065 - DNA, 13 bp, C. elegans
tggtttttggcaa

SEQ ID NO: 731066 - DNA, 13 bp, C. elegans
tggtttttgttca

SEQ ID NO: 731067 - DNA, 13 bp, C. elegans
tggttttttaaaa

SEQ ID NO: 731068 - DNA, 13 bp, C. elegans
tggtttttttcca

SEQ ID NO: 731069 - DNA, 13 bp, C. elegans
tgtaaaaaaattg

SEQ ID NO: 731070 - DNA, 13 bp, C. elegans
tgtaaaaaagtgt

SEQ ID NO: 731071 - DNA, 13 bp, C. elegans
tgtaaaaaatttc

SEQ ID NO: 731072 - DNA, 13 bp, C. elegans
tgtaaaaaatttg

SEQ ID NO: 731073 - DNA, 13 bp, C. elegans
tgtaaaaacaatt

SEQ ID NO: 731074 - DNA, 13 bp, C. elegans
tgtaaaaagtgaa

SEQ ID NO: 731075 - DNA, 13 bp, C. elegans
tgtaaaaatatct

SEQ ID NO: 731076 - DNA, 13 bp, C. elegans
tgtaaaaatatgt

SEQ ID NO: 731077 - DNA, 13 bp, C. elegans
tgtaaaaatattg

SEQ ID NO: 731078 - DNA, 13 bp, C. elegans
tgtaaaaatcaaa

SEQ ID NO: 731079 - DNA, 13 bp, C. elegans
tgtaaaaatcgat

SEQ ID NO: 731080 - DNA, 13 bp, C. elegans
tgtaaaaatgaat

SEQ ID NO: 731081 - DNA, 13 bp, C. elegans
tgtaaaaatggaa

SEQ ID NO: 731082 - DNA, 13 bp, C. elegans
tgtaaaaatgtct

SEQ ID NO: 731083 - DNA, 13 bp, C. elegans
tgtaaaacatttc

SEQ ID NO: 731084 - DNA, 13 bp, C. elegans
tgtaaaagagcgc

SEQ ID NO: 731085 - DNA, 13 bp, C. elegans
tgtaaaatatgaa

SEQ ID NO: 731086 - DNA, 13 bp, C. elegans
tgtaaaatcaatt

SEQ ID NO: 731087 - DNA, 13 bp, C. elegans
tgtaaaatctaaa

SEQ ID NO: 731088 - DNA, 13 bp, C. elegans
tgtaaaatgaata

SEQ ID NO: 731089 - DNA, 13 bp, C. elegans
tgtaaaatgattt

SEQ ID NO: 731090 - DNA, 13 bp, C. elegans
tgtaaaatgtgtt

SEQ ID NO: 731091 - DNA, 13 bp, C. elegans
tgtaaaattccaa

SEQ ID NO: 731092 - DNA, 13 bp, C. elegans
tgtaaaattggaa

SEQ ID NO: 731093 - DNA, 13 bp, C. elegans
tgtaaaattgtga

SEQ ID NO: 731094 - DNA, 13 bp, C. elegans
tgtaaaatttgaa

SEQ ID NO: 731095 - DNA, 13 bp, C. elegans
tgtaaaattttct

SEQ ID NO: 731096 - DNA, 13 bp, C. elegans
tgtaaacgtcgac

SEQ ID NO: 731097 - DNA, 13 bp, C. elegans
tgtaaactatttt

SEQ ID NO: 731098 - DNA, 13 bp, C. elegans
tgtaaactgaaat

SEQ ID NO: 731099 - DNA, 13 bp, C. elegans
tgtaaacttgaaa

SEQ ID NO: 731100 - DNA, 13 bp, C. elegans
tgtaaacttgtga

SEQ ID NO: 731101 - DNA, 13 bp, C. elegans
tgtaaactttgaa

SEQ ID NO: 731102 - DNA, 13 bp, C. elegans
tgtaaagttttaa

SEQ ID NO: 731103 - DNA, 13 bp, C. elegans
tgtaaataaatga

SEQ ID NO: 731104 - DNA, 13 bp, C. elegans
tgtaaataatatg

SEQ ID NO: 731105 - DNA, 13 bp, C. elegans
tgtaaatattgat

SEQ ID NO: 731106 - DNA, 13 bp, C. elegans
tgtaaatgtgaaa

SEQ ID NO: 731107 - DNA, 13 bp, C. elegans
tgtaaattattca

SEQ ID NO: 731108 - DNA, 13 bp, C. elegans
tgtaaattgccaa

SEQ ID NO: 731109 - DNA, 13 bp, C. elegans
tgtaaatttacat

SEQ ID NO: 731110 - DNA, 13 bp, C. elegans
tgtaaatttatca

SEQ ID NO: 731111 - DNA, 13 bp, C. elegans
tgtaaatttgatt

SEQ ID NO: 731112 - DNA, 13 bp, C. elegans
tgtaacagtaaaa

SEQ ID NO: 731113 - DNA, 13 bp, C. elegans
tgtaacattaaaa

SEQ ID NO: 731114 - DNA, 13 bp, C. elegans
tgtaacatttaaa

SEQ ID NO: 731115 - DNA, 13 bp, C. elegans
tgtaacattttaa

SEQ ID NO: 731116 - DNA, 13 bp, C. elegans
tgtaactgaaagc

SEQ ID NO: 731117 - DNA, 13 bp, C. elegans
tgtaacttttttc

SEQ ID NO: 731118 - DNA, 13 bp, C. elegans
tgtaagaaaattt

SEQ ID NO: 731119 - DNA, 13 bp, C. elegans
tgtaataaactac

SEQ ID NO: 731120 - DNA, 13 bp, C. elegans
tgtaataaattct

SEQ ID NO: 731121 - DNA, 13 bp, C. elegans
tgtaataactttt

SEQ ID NO: 731122 - DNA, 13 bp, C. elegans
tgtaataattgtt

SEQ ID NO: 731123 - DNA, 13 bp, C. elegans
tgtaatattctaa

SEQ ID NO: 731124 - DNA, 13 bp, C. elegans
tgtaattaaaaca

SEQ ID NO: 731125 - DNA, 13 bp, C. elegans
tgtaattatttca

SEQ ID NO: 731126 - DNA, 13 bp, C. elegans
tgtaattcaaaat

SEQ ID NO: 731127 - DNA, 13 bp, C. elegans
tgtaattctgaaa

SEQ ID NO: 731128 - DNA, 13 bp, C. elegans
tgtaattgaaaat

SEQ ID NO: 731129 - DNA, 13 bp, C. elegans
tgtaattgaataa

SEQ ID NO: 731130 - DNA, 13 bp, C. elegans
tgtaattgcaaca

SEQ ID NO: 731131 - DNA, 13 bp, C. elegans
tgtaatttatttc

SEQ ID NO: 731132 - DNA, 13 bp, C. elegans
tgtaatttcaaac

SEQ ID NO: 731133 - DNA, 13 bp, C. elegans
tgtaatttccaaa

SEQ ID NO: 731134 - DNA, 13 bp, C. elegans
tgtaattttacaa

SEQ ID NO: 731135 - DNA, 13 bp, C. elegans
tgtaattttctgt

SEQ ID NO: 731136 - DNA, 13 bp, C. elegans
tgtaatttttcga

SEQ ID NO: 731137 - DNA, 13 bp, C. elegans
tgtacaacaaaat

SEQ ID NO: 731138 - DNA, 13 bp, C. elegans
tgtacaatttcca

SEQ ID NO: 731139 - DNA, 13 bp, C. elegans
tgtacacttctcc

SEQ ID NO: 731140 - DNA, 13 bp, C. elegans
tgtacatattttc

SEQ ID NO: 731141 - DNA, 13 bp, C. elegans
tgtaccgtactcc

SEQ ID NO: 731142 - DNA, 13 bp, C. elegans
tgtactacctttt

SEQ ID NO: 731143 - DNA, 13 bp, C. elegans
tgtactatttctg

SEQ ID NO: 731144 - DNA, 13 bp, C. elegans
tgtacttaaattg

SEQ ID NO: 731145 - DNA, 13 bp, C. elegans
tgtacttctcgag

SEQ ID NO: 731146 - DNA, 13 bp, C. elegans
tgtactttatatt

SEQ ID NO: 731147 - DNA, 13 bp, C. elegans
tgtactttgtagt

SEQ ID NO: 731148 - DNA, 13 bp, C. elegans
tgtacttttcaat

SEQ ID NO: 731149 - DNA, 13 bp, C. elegans
tgtacttttcatt

SEQ ID NO: 731150 - DNA, 13 bp, C. elegans
tgtacttttcttc

SEQ ID NO: 731151 - DNA, 13 bp, C. elegans
tgtactttttaat

SEQ ID NO: 731152 - DNA, 13 bp, C. elegans
tgtacttttttcc

SEQ ID NO: 731153 - DNA, 13 bp, C. elegans
tgtagaaaacatt

SEQ ID NO: 731154 - DNA, 13 bp, C. elegans
tgtagaaaatttt

SEQ ID NO: 731155 - DNA, 13 bp, C. elegans
tgtagaacatttt

SEQ ID NO: 731156 - DNA, 13 bp, C. elegans
tgtagaatgaaaa

SEQ ID NO: 731157 - DNA, 13 bp, C. elegans
tgtagaattgctc

SEQ ID NO: 731158 - DNA, 13 bp, C. elegans
tgtagaatttctg

SEQ ID NO: 731159 - DNA, 13 bp, C. elegans
tgtagaatttttc

SEQ ID NO: 731160 - DNA, 13 bp, C. elegans
tgtagagattttt

SEQ ID NO: 731161 - DNA, 13 bp, C. elegans
tgtagatcaaaca

SEQ ID NO: 731162 - DNA, 13 bp, C. elegans
tgtagatcaaagt

SEQ ID NO: 731163 - DNA, 13 bp, C. elegans
tgtagatcaaatc

SEQ ID NO: 731164 - DNA, 13 bp, C. elegans
tgtagatcacaaa

SEQ ID NO: 731165 - DNA, 13 bp, C. elegans
tgtagattttaaa

SEQ ID NO: 731166 - DNA, 13 bp, C. elegans
tgtagcgcttgtg

SEQ ID NO: 731167 - DNA, 13 bp, C. elegans
tgtaggaaaattc

SEQ ID NO: 731168 - DNA, 13 bp, C. elegans
tgtaggaacattc

SEQ ID NO: 731169 - DNA, 13 bp, C. elegans
tgtagtaaaaaat

SEQ ID NO: 731170 - DNA, 13 bp, C. elegans
tgtagtatttgta

SEQ ID NO: 731171 - DNA, 13 bp, C. elegans
tgtagtcgaattt

SEQ ID NO: 731172 - DNA, 13 bp, C. elegans
tgtagtcggtgtt

SEQ ID NO: 731173 - DNA, 13 bp, C. elegans
tgtagtctgtagt

SEQ ID NO: 731174 - DNA, 13 bp, C. elegans
tgtagtctgtgag

SEQ ID NO: 731175 - DNA, 13 bp, C. elegans
tgtagttgaaagt

SEQ ID NO: 731176 - DNA, 13 bp, C. elegans
tgtagttgtagtt

SEQ ID NO: 731177 - DNA, 13 bp, C. elegans
tgtagtttaaaac

SEQ ID NO: 731178 - DNA, 13 bp, C. elegans
tgtagtttatagt

SEQ ID NO: 731179 - DNA, 13 bp, C. elegans
tgtagtttcagaa

SEQ ID NO: 731180 - DNA, 13 bp, C. elegans
tgtagtttgatct

SEQ ID NO: 731181 - DNA, 13 bp, C. elegans
tgtagtttgtagt

SEQ ID NO: 731182 - DNA, 13 bp, C. elegans
tgtagttttcgcg

SEQ ID NO: 731183 - DNA, 13 bp, C. elegans
tgtagttttggaa

SEQ ID NO: 731184 - DNA, 13 bp, C. elegans
tgtataacatttt

SEQ ID NO: 731185 - DNA, 13 bp, C. elegans
tgtataatttcca

SEQ ID NO: 731186 - DNA, 13 bp, C. elegans
tgtatacaaaaaa

SEQ ID NO: 731187 - DNA, 13 bp, C. elegans
tgtatatgtatat

SEQ ID NO: 731188 - DNA, 13 bp, C. elegans
tgtatattctgaa

SEQ ID NO: 731189 - DNA, 13 bp, C. elegans
tgtatatttttca

SEQ ID NO: 731190 - DNA, 13 bp, C. elegans
tgtatcataattt

SEQ ID NO: 731191 - DNA, 13 bp, C. elegans
tgtatcatatttg

SEQ ID NO: 731192 - DNA, 13 bp, C. elegans
tgtatcatttttg

SEQ ID NO: 731193 - DNA, 13 bp, C. elegans
tgtatccgaatgt

SEQ ID NO: 731194 - DNA, 13 bp, C. elegans
tgtatctcccgcc

SEQ ID NO: 731195 - DNA, 14 bp, C. elegans
tgtatctgaagacc

SEQ ID NO: 731196 - DNA, 13 bp, C. elegans
tgtatgcaatttt

SEQ ID NO: 731197 - DNA, 13 bp, C. elegans
tgtatgggaatgt

SEQ ID NO: 731198 - DNA, 13 bp, C. elegans
tgtatgtataata

SEQ ID NO: 731199 - DNA, 13 bp, C. elegans
tgtatgtatataa

SEQ ID NO: 731200 - DNA, 13 bp, C. elegans
tgtatgtatgtat

SEQ ID NO: 731201 - DNA, 13 bp, C. elegans
tgtatgtatgtgt

SEQ ID NO: 731202 - DNA, 13 bp, C. elegans
tgtatgtgtatgt

SEQ ID NO: 731203 - DNA, 13 bp, C. elegans
tgtatgtgtgtat

SEQ ID NO: 731204 - DNA, 13 bp, C. elegans
tgtattaaaacac

SEQ ID NO: 731205 - DNA, 13 bp, C. elegans
tgtattcaaaaat

SEQ ID NO: 731206 - DNA, 14 bp, C. elegans
tgtattcacttatg

SEQ ID NO: 731207 - DNA, 26 bp, C. elegans
tgtattcagtgggcaagcagcggtga

SEQ ID NO: 731208 - DNA, 13 bp, C. elegans
tgtattcattttc

SEQ ID NO: 731209 - DNA, 13 bp, C. elegans
tgtattcttggaa

SEQ ID NO: 731210 - DNA, 13 bp, C. elegans
tgtattgaaaaat

SEQ ID NO: 731211 - DNA, 13 bp, C. elegans
tgtattggaaatt

SEQ ID NO: 731212 - DNA, 13 bp, C. elegans
tgtatttattcat

SEQ ID NO: 731213 - DNA, 13 bp, C. elegans
tgtatttcagtga

SEQ ID NO: 731214 - DNA, 13 bp, C. elegans
tgtatttccaatt

SEQ ID NO: 731215 - DNA, 13 bp, C. elegans
tgtatttcttcaa

SEQ ID NO: 731216 - DNA, 13 bp, C. elegans
tgtatttcttgaa

SEQ ID NO: 731217 - DNA, 13 bp, C. elegans
tgtatttgaaaat

SEQ ID NO: 731218 - DNA, 13 bp, C. elegans
tgtatttgaaatt

SEQ ID NO: 731219 - DNA, 13 bp, C. elegans
tgtattttaacac

SEQ ID NO: 731220 - DNA, 13 bp, C. elegans
tgtattttacaaa

SEQ ID NO: 731221 - DNA, 13 bp, C. elegans
tgtattttatcaa

SEQ ID NO: 731222 - DNA, 13 bp, C. elegans
tgtattttattca

SEQ ID NO: 731223 - DNA, 13 bp, C. elegans
tgtattttcagaa

SEQ ID NO: 731224 - DNA, 13 bp, C. elegans
tgtattttcagtt

SEQ ID NO: 731225 - DNA, 13 bp, C. elegans
tgtattttgaaag

SEQ ID NO: 731226 - DNA, 13 bp, C. elegans
tgtattttgaatc

SEQ ID NO: 731227 - DNA, 13 bp, C. elegans
tgtattttggaaa

SEQ ID NO: 731228 - DNA, 13 bp, C. elegans
tgtattttgtaaa

SEQ ID NO: 731229 - DNA, 13 bp, C. elegans
tgtatttttacat

SEQ ID NO: 731230 - DNA, 13 bp, C. elegans
tgtatttttagaa

SEQ ID NO: 731231 - DNA, 13 bp, C. elegans
tgtatttttatcg

SEQ ID NO: 731232 - DNA, 13 bp, C. elegans
tgtatttttcata

SEQ ID NO: 731233 - DNA, 13 bp, C. elegans
tgtatttttccac

SEQ ID NO: 731234 - DNA, 13 bp, C. elegans
tgtatttttcgct

SEQ ID NO: 731235 - DNA, 13 bp, C. elegans
tgtatttttctca

SEQ ID NO: 731236 - DNA, 13 bp, C. elegans
tgtatttttgaaa

SEQ ID NO: 731237 - DNA, 13 bp, C. elegans
tgtatttttgctc

SEQ ID NO: 731238 - DNA, 13 bp, C. elegans
tgtatttttggaa

SEQ ID NO: 731239 - DNA, 13 bp, C. elegans
tgtatttttggct

SEQ ID NO: 731240 - DNA, 13 bp, C. elegans
tgtattttttcca

SEQ ID NO: 731241 - DNA, 13 bp, C. elegans
tgtcaaaaaagaa

SEQ ID NO: 731242 - DNA, 13 bp, C. elegans
tgtcaaaaaatgc

SEQ ID NO: 731243 - DNA, 13 bp, C. elegans
tgtcaaaaaattc

SEQ ID NO: 731244 - DNA, 13 bp, C. elegans
tgtcaaaaacaat

SEQ ID NO: 731245 - DNA, 13 bp, C. elegans
tgtcaaaaacttt

SEQ ID NO: 731246 - DNA, 13 bp, C. elegans
tgtcaaaaagaaa

SEQ ID NO: 731247 - DNA, 13 bp, C. elegans
tgtcaaaaagtga

SEQ ID NO: 731248 - DNA, 13 bp, C. elegans
tgtcaaaaatata

SEQ ID NO: 731249 - DNA, 13 bp, C. elegans
tgtcaaaaatgaa

SEQ ID NO: 731250 - DNA, 13 bp, C. elegans
tgtcaaaaatgca

SEQ ID NO: 731251 - DNA, 13 bp, C. elegans
tgtcaaaacaaca

SEQ ID NO: 731252 - DNA, 13 bp, C. elegans
tgtcaaaatatag

SEQ ID NO: 731253 - DNA, 13 bp, C. elegans
tgtcaaaatgtca

SEQ ID NO: 731254 - DNA, 13 bp, C. elegans
tgtcaaaatgtcc

SEQ ID NO: 731255 - DNA, 13 bp, C. elegans
tgtcaaactttgt

SEQ ID NO: 731256 - DNA, 13 bp, C. elegans
tgtcaaatacttt

SEQ ID NO: 731257 - DNA, 13 bp, C. elegans
tgtcaaatgaaaa

SEQ ID NO: 731258 - DNA, 13 bp, C. elegans
tgtcaaattgaag

SEQ ID NO: 731259 - DNA, 13 bp, C. elegans
tgtcaaattgcca

SEQ ID NO: 731260 - DNA, 13 bp, C. elegans
tgtcaaatttgtt

SEQ ID NO: 731261 - DNA, 13 bp, C. elegans
tgtcaaatttttg

SEQ ID NO: 731262 - DNA, 13 bp, C. elegans
tgtcaaatttttt

SEQ ID NO: 731263 - DNA, 13 bp, C. elegans
tgtcaactacaaa

SEQ ID NO: 731264 - DNA, 13 bp, C. elegans
tgtcaactgacaa

SEQ ID NO: 731265 - DNA, 13 bp, C. elegans
tgtcaactttgat

SEQ ID NO: 731266 - DNA, 13 bp, C. elegans
tgtcaagaaaatg

SEQ ID NO: 731267 - DNA, 13 bp, C. elegans
tgtcaagtcccgt

SEQ ID NO: 731268 - DNA, 13 bp, C. elegans
tgtcaatacattg

SEQ ID NO: 731269 - DNA, 13 bp, C. elegans
tgtcaatcaaagt

SEQ ID NO: 731270 - DNA, 13 bp, C. elegans
tgtcaatcatttt

SEQ ID NO: 731271 - DNA, 13 bp, C. elegans
tgtcaatcttttt

SEQ ID NO: 731272 - DNA, 14 bp, C. elegans
tgtcaatggagcgc

SEQ ID NO: 731273 - DNA, 13 bp, C. elegans
tgtcaattaaaaa

SEQ ID NO: 731274 - DNA, 13 bp, C. elegans
tgtcaattggaaa

SEQ ID NO: 731275 - DNA, 13 bp, C. elegans
tgtcaatttcaat

SEQ ID NO: 731276 - DNA, 13 bp, C. elegans
tgtcaatttccag

SEQ ID NO: 731277 - DNA, 13 bp, C. elegans
tgtcaatttcctg

SEQ ID NO: 731278 - DNA, 13 bp, C. elegans
tgtcaatttgaat

SEQ ID NO: 731279 - DNA, 13 bp, C. elegans
tgtcaattttaaa

SEQ ID NO: 731280 - DNA, 13 bp, C. elegans
tgtcaattttaat

SEQ ID NO: 731281 - DNA, 13 bp, C. elegans
tgtcaattttgca

SEQ ID NO: 731282 - DNA, 13 bp, C. elegans
tgtcaattttgtg

SEQ ID NO: 731283 - DNA, 13 bp, C. elegans
tgtcacaattttc

SEQ ID NO: 731284 - DNA, 13 bp, C. elegans
tgtcacaattttt

SEQ ID NO: 731285 - DNA, 13 bp, C. elegans
tgtcacacaaaaa

SEQ ID NO: 731286 - DNA, 13 bp, C. elegans
tgtcacatgcgag

SEQ ID NO: 731287 - DNA, 13 bp, C. elegans
tgtcacatttttg

SEQ ID NO: 731288 - DNA, 13 bp, C. elegans
tgtcacctcaaat

SEQ ID NO: 731289 - DNA, 13 bp, C. elegans
tgtcacctttttt

SEQ ID NO: 731290 - DNA, 13 bp, C. elegans
tgtcagaaaaaag

SEQ ID NO: 731291 - DNA, 13 bp, C. elegans
tgtcagaaagtct

SEQ ID NO: 731292 - DNA, 13 bp, C. elegans
tgtcagacaagga

SEQ ID NO: 731293 - DNA, 13 bp, C. elegans
tgtcagttattca

SEQ ID NO: 731294 - DNA, 13 bp, C. elegans
tgtcagttgacaa

SEQ ID NO: 731295 - DNA, 13 bp, C. elegans
tgtcagttggcaa

SEQ ID NO: 731296 - DNA, 13 bp, C. elegans
tgtcagttttttc

SEQ ID NO: 731297 - DNA, 13 bp, C. elegans
tgtcagttttttg

SEQ ID NO: 731298 - DNA, 13 bp, C. elegans
tgtcataataaaa

SEQ ID NO: 731299 - DNA, 13 bp, C. elegans
tgtcataataatt

SEQ ID NO: 731300 - DNA, 13 bp, C. elegans
tgtcatattatac

SEQ ID NO: 731301 - DNA, 13 bp, C. elegans
tgtcatcaaacga

SEQ ID NO: 731302 - DNA, 13 bp, C. elegans
tgtcatcatcatc

SEQ ID NO: 731303 - DNA, 13 bp, C. elegans
tgtcattaaaaaa

SEQ ID NO: 731304 - DNA, 13 bp, C. elegans
tgtcattaaaatt

SEQ ID NO: 731305 - DNA, 13 bp, C. elegans
tgtcattcatttt

SEQ ID NO: 731306 - DNA, 13 bp, C. elegans
tgtcatttcaaat

SEQ ID NO: 731307 - DNA, 13 bp, C. elegans
tgtcattttcaaa

SEQ ID NO: 731308 - DNA, 13 bp, C. elegans
tgtcattttctga

SEQ ID NO: 731309 - DNA, 13 bp, C. elegans
tgtcattttggct

SEQ ID NO: 731310 - DNA, 13 bp, C. elegans
tgtcattttgtag

SEQ ID NO: 731311 - DNA, 13 bp, C. elegans
tgtcatttttcga

SEQ ID NO: 731312 - DNA, 13 bp, C. elegans
tgtcatttttgcc

SEQ ID NO: 731313 - DNA, 13 bp, C. elegans
tgtcatttttgtg

SEQ ID NO: 731314 - DNA, 13 bp, C. elegans
tgtcattttttaa

SEQ ID NO: 731315 - DNA, 13 bp, C. elegans
tgtccattctgtt

SEQ ID NO: 731316 - DNA, 13 bp, C. elegans
tgtccatttttct

SEQ ID NO: 731317 - DNA, 13 bp, C. elegans
tgtcccatgtccc

SEQ ID NO: 731318 - DNA, 13 bp, C. elegans
tgtcccgagaaat

SEQ ID NO: 731319 - DNA, 13 bp, C. elegans
tgtcccgttgtcc

SEQ ID NO: 731320 - DNA, 13 bp, C. elegans
tgtcccgttttta

SEQ ID NO: 731321 - DNA, 18 bp, C. elegans
tgtccgtgtggagtacac

SEQ ID NO: 731322 - DNA, 13 bp, C. elegans
tgtccgtttggtt

SEQ ID NO: 731323 - DNA, 13 bp, C. elegans
tgtcgaaaaaccc

SEQ ID NO: 731324 - DNA, 13 bp, C. elegans
tgtcgaaaagttg

SEQ ID NO: 731325 - DNA, 13 bp, C. elegans
tgtcgaaaatcaa

SEQ ID NO: 731326 - DNA, 13 bp, C. elegans
tgtcgaaaattct

SEQ ID NO: 731327 - DNA, 13 bp, C. elegans
tgtcgaaattgaa

SEQ ID NO: 731328 - DNA, 13 bp, C. elegans
tgtcgaattttaa

SEQ ID NO: 731329 - DNA, 13 bp, C. elegans
tgtcgatttacga

SEQ ID NO: 731330 - DNA, 13 bp, C. elegans
tgtcgatttacgg

SEQ ID NO: 731331 - DNA, 13 bp, C. elegans
tgtcggaattgaa

SEQ ID NO: 731332 - DNA, 13 bp, C. elegans
tgtcggccgctcc

SEQ ID NO: 731333 - DNA, 13 bp, C. elegans
tgtcggccgcttc

SEQ ID NO: 731334 - DNA, 13 bp, C. elegans
tgtcggctgcaat

SEQ ID NO: 731335 - DNA, 13 bp, C. elegans
tgtcggctgctac

SEQ ID NO: 731336 - DNA, 13 bp, C. elegans
tgtcggctgctag

SEQ ID NO: 731337 - DNA, 13 bp, C. elegans
tgtcggctgctat

SEQ ID NO: 731338 - DNA, 13 bp, C. elegans
tgtcggctgctca

SEQ ID NO: 731339 - DNA, 13 bp, C. elegans
tgtcggctgcttc

SEQ ID NO: 731340 - DNA, 13 bp, C. elegans
tgtcgtcgtcgtc

SEQ ID NO: 731341 - DNA, 13 bp, C. elegans
tgtctaaagaaaa

SEQ ID NO: 731342 - DNA, 13 bp, C. elegans
tgtctacagaaga

SEQ ID NO: 731343 - DNA, 13 bp, C. elegans
tgtctagaatttt

SEQ ID NO: 731344 - DNA, 13 bp, C. elegans
tgtctatgtctct

SEQ ID NO: 731345 - DNA, 13 bp, C. elegans
tgtctatttctct

SEQ ID NO: 731346 - DNA, 13 bp, C. elegans
tgtctctctgtct

SEQ ID NO: 731347 - DNA, 13 bp, C. elegans
tgtctcttcaact

SEQ ID NO: 731348 - DNA, 13 bp, C. elegans
tgtctgaaaaaga

SEQ ID NO: 731349 - DNA, 13 bp, C. elegans
tgtctgaaaacat

SEQ ID NO: 731350 - DNA, 13 bp, C. elegans
tgtctgaaattca

SEQ ID NO: 731351 - DNA, 13 bp, C. elegans
tgtctgaaatttt

SEQ ID NO: 731352 - DNA, 13 bp, C. elegans
tgtctgaagtttt

SEQ ID NO: 731353 - DNA, 13 bp, C. elegans
tgtctgaatattt

SEQ ID NO: 731354 - DNA, 13 bp, C. elegans
tgtctgcactctc

SEQ ID NO: 731355 - DNA, 13 bp, C. elegans
tgtctgcgtctca

SEQ ID NO: 731356 - DNA, 13 bp, C. elegans
tgtctgcgtctcc

SEQ ID NO: 731357 - DNA, 13 bp, C. elegans
tgtctggaaattt

SEQ ID NO: 731358 - DNA, 13 bp, C. elegans
tgtctggaatttt

SEQ ID NO: 731359 - DNA, 13 bp, C. elegans
tgtctgtcaatct

SEQ ID NO: 731360 - DNA, 13 bp, C. elegans
tgtcttatttcgg

SEQ ID NO: 731361 - DNA, 13 bp, C. elegans
tgtcttattttca

SEQ ID NO: 731362 - DNA, 13 bp, C. elegans
tgtcttccactat

SEQ ID NO: 731363 - DNA, 13 bp, C. elegans
tgtcttgaaaaaa

SEQ ID NO: 731364 - DNA, 13 bp, C. elegans
tgtcttgaaattg

SEQ ID NO: 731365 - DNA, 13 bp, C. elegans
tgtctttgaaatt

SEQ ID NO: 731366 - DNA, 13 bp, C. elegans
tgtcttttttgca

SEQ ID NO: 731367 - DNA, 13 bp, C. elegans
tgtgaaaaaaacg

SEQ ID NO: 731368 - DNA, 13 bp, C. elegans
tgtgaaaaaagtg

SEQ ID NO: 731369 - DNA, 13 bp, C. elegans
tgtgaaaaaatat

SEQ ID NO: 731370 - DNA, 13 bp, C. elegans
tgtgaaaaaatgt

SEQ ID NO: 731371 - DNA, 13 bp, C. elegans
tgtgaaaaacaaa

SEQ ID NO: 731372 - DNA, 13 bp, C. elegans
tgtgaaaaacgaa

SEQ ID NO: 731373 - DNA, 13 bp, C. elegans
tgtgaaaaactga

SEQ ID NO: 731374 - DNA, 13 bp, C. elegans
tgtgaaaaatata

SEQ ID NO: 731375 - DNA, 13 bp, C. elegans
tgtgaaaaatcaa

SEQ ID NO: 731376 - DNA, 13 bp, C. elegans
tgtgaaaaattaa

SEQ ID NO: 731377 - DNA, 13 bp, C. elegans
tgtgaaaacgaaa

SEQ ID NO: 731378 - DNA, 13 bp, C. elegans
tgtgaaaagaaat

SEQ ID NO: 731379 - DNA, 13 bp, C. elegans
tgtgaaaataatt

SEQ ID NO: 731380 - DNA, 13 bp, C. elegans
tgtgaaaattgga

SEQ ID NO: 731381 - DNA, 13 bp, C. elegans
tgtgaaaatttaa

SEQ ID NO: 731382 - DNA, 13 bp, C. elegans
tgtgaaacagtag

SEQ ID NO: 731383 - DNA, 13 bp, C. elegans
tgtgaaacttgaa

SEQ ID NO: 731384 - DNA, 13 bp, C. elegans
tgtgaaagaagag

SEQ ID NO: 731385 - DNA, 13 bp, C. elegans
tgtgaaataataa

SEQ ID NO: 731386 - DNA, 13 bp, C. elegans
tgtgaaataattt

SEQ ID NO: 731387 - DNA, 13 bp, C. elegans
tgtgaaatacaaa

SEQ ID NO: 731388 - DNA, 13 bp, C. elegans
tgtgaaattaaaa

SEQ ID NO: 731389 - DNA, 13 bp, C. elegans
tgtgaaattatga

SEQ ID NO: 731390 - DNA, 13 bp, C. elegans
tgtgaaattgaaa

SEQ ID NO: 731391 - DNA, 13 bp, C. elegans
tgtgaaatttcaa

SEQ ID NO: 731392 - DNA, 13 bp, C. elegans
tgtgaacactttt

SEQ ID NO: 731393 - DNA, 13 bp, C. elegans
tgtgaaccatttt

SEQ ID NO: 731394 - DNA, 13 bp, C. elegans
tgtgaagaaaaac

SEQ ID NO: 731395 - DNA, 13 bp, C. elegans
tgtgaagtaaaaa

SEQ ID NO: 731396 - DNA, 13 bp, C. elegans
tgtgaagtttttg

SEQ ID NO: 731397 - DNA, 13 bp, C. elegans
tgtgaatatttta

SEQ ID NO: 731398 - DNA, 13 bp, C. elegans
tgtgaattcagtc

SEQ ID NO: 731399 - DNA, 13 bp, C. elegans
tgtgaatttaatt

SEQ ID NO: 731400 - DNA, 13 bp, C. elegans
tgtgaatttcaaa

SEQ ID NO: 731401 - DNA, 13 bp, C. elegans
tgtgaatttcaga

SEQ ID NO: 731402 - DNA, 13 bp, C. elegans
tgtgaattttaat

SEQ ID NO: 731403 - DNA, 13 bp, C. elegans
tgtgaattttcga

SEQ ID NO: 731404 - DNA, 13 bp, C. elegans
tgtgacgtcacaa

SEQ ID NO: 731405 - DNA, 13 bp, C. elegans
tgtgacgtcagaa

SEQ ID NO: 731406 - DNA, 13 bp, C. elegans
tgtgacgtcagca

SEQ ID NO: 731407 - DNA, 13 bp, C. elegans
tgtgacgtcatca

SEQ ID NO: 731408 - DNA, 13 bp, C. elegans
tgtgactttttgt

SEQ ID NO: 731409 - DNA, 13 bp, C. elegans
tgtgagaaaattc

SEQ ID NO: 731410 - DNA, 13 bp, C. elegans
tgtgagaagaaaa

SEQ ID NO: 731411 - DNA, 13 bp, C. elegans
tgtgagagaaaga

SEQ ID NO: 731412 - DNA, 13 bp, C. elegans
tgtgataattatt

SEQ ID NO: 731413 - DNA, 13 bp, C. elegans
tgtgataattttg

SEQ ID NO: 731414 - DNA, 13 bp, C. elegans
tgtgatatttggt

SEQ ID NO: 731415 - DNA, 13 bp, C. elegans
tgtgatctacaaa

SEQ ID NO: 731416 - DNA, 13 bp, C. elegans
tgtgatctaccaa

SEQ ID NO: 731417 - DNA, 13 bp, C. elegans
tgtgatgacgtca

SEQ ID NO: 731418 - DNA, 13 bp, C. elegans
tgtgatgatgatg

SEQ ID NO: 731419 - DNA, 14 bp, C. elegans
tgtgatgcatataa

SEQ ID NO: 731420 - DNA, 13 bp, C. elegans
tgtgattaaaatt

SEQ ID NO: 731421 - DNA, 13 bp, C. elegans
tgtgatttaaaaa

SEQ ID NO: 731422 - DNA, 13 bp, C. elegans
tgtgatttgtgat

SEQ ID NO: 731423 - DNA, 13 bp, C. elegans
tgtgattttcaaa

SEQ ID NO: 731424 - DNA, 13 bp, C. elegans
tgtgattttcatc

SEQ ID NO: 731425 - DNA, 13 bp, C. elegans
tgtgattttccaa

SEQ ID NO: 731426 - DNA, 13 bp, C. elegans
tgtgattttcgta

SEQ ID NO: 731427 - DNA, 13 bp, C. elegans
tgtgatttttgac

SEQ ID NO: 731428 - DNA, 13 bp, C. elegans
tgtgattttttcc

SEQ ID NO: 731429 - DNA, 13 bp, C. elegans
tgtgcaaaaaata

SEQ ID NO: 731430 - DNA, 13 bp, C. elegans
tgtgcaaaaaatt

SEQ ID NO: 731431 - DNA, 13 bp, C. elegans
tgtgcaaaatgtg

SEQ ID NO: 731432 - DNA, 13 bp, C. elegans
tgtgcaaacaccg

SEQ ID NO: 731433 - DNA, 13 bp, C. elegans
tgtgcaaagtttt

SEQ ID NO: 731434 - DNA, 13 bp, C. elegans
tgtgcaaataaaa

SEQ ID NO: 731435 - DNA, 13 bp, C. elegans
tgtgcaatacgta

SEQ ID NO: 731436 - DNA, 13 bp, C. elegans
tgtgcacaattga

SEQ ID NO: 731437 - DNA, 13 bp, C. elegans
tgtgcaccttcaa

SEQ ID NO: 731438 - DNA, 14 bp, C. elegans
tgtgcactggtttt

SEQ ID NO: 731439 - DNA, 13 bp, C. elegans
tgtgcactttttt

SEQ ID NO: 731440 - DNA, 13 bp, C. elegans
tgtgcagccgaca

SEQ ID NO: 731441 - DNA, 13 bp, C. elegans
tgtgcagtttttt

SEQ ID NO: 731442 - DNA, 197 bp, C. elegans
tgtgcatttgctcgattggccaagtcagtctccggacttgaatccaatagagcatttgtgggaagagttggaaagacgtcttggaggtattcgggcttcaaatgcagatgccaaattcaaccagttggaaaacgcttggaaagctatccccatgtcagttattcacaagctgatcgactcgatgccacgtcgttgtc

SEQ ID NO: 731443 - DNA, 13 bp, C. elegans
tgtgcattttctc

SEQ ID NO: 731444 - DNA, 13 bp, C. elegans
tgtgcatttttgc

SEQ ID NO: 731445 - DNA, 13 bp, C. elegans
tgtgcattttttc

SEQ ID NO: 731446 - DNA, 13 bp, C. elegans
tgtgccaaaatct

SEQ ID NO: 731447 - DNA, 13 bp, C. elegans
tgtgccattttac

SEQ ID NO: 731448 - DNA, 13 bp, C. elegans
tgtgccattttga

SEQ ID NO: 731449 - DNA, 13 bp, C. elegans
tgtgcctttaaag

SEQ ID NO: 731450 - DNA, 13 bp, C. elegans
tgtgcctttttga

SEQ ID NO: 731451 - DNA, 13 bp, C. elegans
tgtgcgcctttaa

SEQ ID NO: 731452 - DNA, 13 bp, C. elegans
tgtgcgcctttag

SEQ ID NO: 731453 - DNA, 13 bp, C. elegans
tgtgcggcaaatt

SEQ ID NO: 731454 - DNA, 13 bp, C. elegans
tgtgctcaaaaaa

SEQ ID NO: 731455 - DNA, 13 bp, C. elegans
tgtgctcaaatga

SEQ ID NO: 731456 - DNA, 14 bp, C. elegans
tgtgctccagaaga

SEQ ID NO: 731457 - DNA, 13 bp, C. elegans
tgtgctcctttaa

SEQ ID NO: 731458 - DNA, 13 bp, C. elegans
tgtgctctatcgg

SEQ ID NO: 731459 - DNA, 13 bp, C. elegans
tgtgctctattgc

SEQ ID NO: 731460 - DNA, 13 bp, C. elegans
tgtgctctattgt

SEQ ID NO: 731461 - DNA, 13 bp, C. elegans
tgtgctcttctgg

SEQ ID NO: 731462 - DNA, 13 bp, C. elegans
tgtgctgaaattt

SEQ ID NO: 731463 - DNA, 13 bp, C. elegans
tgtggaaaaaagt

SEQ ID NO: 731464 - DNA, 13 bp, C. elegans
tgtggaaaaagtg

SEQ ID NO: 731465 - DNA, 13 bp, C. elegans
tgtggaaaagaaa

SEQ ID NO: 731466 - DNA, 13 bp, C. elegans
tgtggaaaatgtg

SEQ ID NO: 731467 - DNA, 13 bp, C. elegans
tgtggaaaattaa

SEQ ID NO: 731468 - DNA, 13 bp, C. elegans
tgtggaaatattt

SEQ ID NO: 731469 - DNA, 13 bp, C. elegans
tgtggaaatttaa

SEQ ID NO: 731470 - DNA, 13 bp, C. elegans
tgtggaaatttca

SEQ ID NO: 731471 - DNA, 13 bp, C. elegans
tgtggaaatttga

SEQ ID NO: 731472 - DNA, 13 bp, C. elegans
tgtggaatatttt

SEQ ID NO: 731473 - DNA, 13 bp, C. elegans
tgtggaattttca

SEQ ID NO: 731474 - DNA, 13 bp, C. elegans
tgtggcttcatcg

SEQ ID NO: 731475 - DNA, 13 bp, C. elegans
tgtgggcaaaaaa

SEQ ID NO: 731476 - DNA, 13 bp, C. elegans
tgtggtgaagttt

SEQ ID NO: 731477 - DNA, 13 bp, C. elegans
tgtgtaaaaaata

SEQ ID NO: 731478 - DNA, 13 bp, C. elegans
tgtgtaattttct

SEQ ID NO: 731479 - DNA, 13 bp, C. elegans
tgtgtatatttac

SEQ ID NO: 731480 - DNA, 13 bp, C. elegans
tgtgtcaaaaaat

SEQ ID NO: 731481 - DNA, 13 bp, C. elegans
tgtgtcaaacatt

SEQ ID NO: 731482 - DNA, 13 bp, C. elegans
tgtgtctctctct

SEQ ID NO: 731483 - DNA, 13 bp, C. elegans
tgtgtctctctgt

SEQ ID NO: 731484 - DNA, 13 bp, C. elegans
tgtgtgacgtcac

SEQ ID NO: 731485 - DNA, 13 bp, C. elegans
tgtgtgacgtcat

SEQ ID NO: 731486 - DNA, 13 bp, C. elegans
tgtgtgcactttt

SEQ ID NO: 731487 - DNA, 13 bp, C. elegans
tgtgtgcctttaa

SEQ ID NO: 731488 - DNA, 13 bp, C. elegans
tgtgtggaatttt

SEQ ID NO: 731489 - DNA, 13 bp, C. elegans
tgtgtgtaaaaga

SEQ ID NO: 731490 - DNA, 13 bp, C. elegans
tgtgtgtctctct

SEQ ID NO: 731491 - DNA, 13 bp, C. elegans
tgtgtgtgtgtcc

SEQ ID NO: 731492 - DNA, 13 bp, C. elegans
tgtgtgttcaaaa

SEQ ID NO: 731493 - DNA, 13 bp, C. elegans
tgtgtgttggaaa

SEQ ID NO: 731494 - DNA, 13 bp, C. elegans
tgtgtgtttcaaa

SEQ ID NO: 731495 - DNA, 13 bp, C. elegans
tgtgtgttttcaa

SEQ ID NO: 731496 - DNA, 13 bp, C. elegans
tgtgttaaaaatt

SEQ ID NO: 731497 - DNA, 13 bp, C. elegans
tgtgttcagaaaa

SEQ ID NO: 731498 - DNA, 13 bp, C. elegans
tgtgttgatttac

SEQ ID NO: 731499 - DNA, 13 bp, C. elegans
tgtgttttaataa

SEQ ID NO: 731500 - DNA, 13 bp, C. elegans
tgttaaaaaattc

SEQ ID NO: 731501 - DNA, 13 bp, C. elegans
tgttaaaaagtaa

SEQ ID NO: 731502 - DNA, 13 bp, C. elegans
tgttaaaaagttt

SEQ ID NO: 731503 - DNA, 13 bp, C. elegans
tgttaaaaatcaa

SEQ ID NO: 731504 - DNA, 13 bp, C. elegans
tgttaaaacaaaa

SEQ ID NO: 731505 - DNA, 13 bp, C. elegans
tgttaaaacttca

SEQ ID NO: 731506 - DNA, 13 bp, C. elegans
tgttaaaacttta

SEQ ID NO: 731507 - DNA, 13 bp, C. elegans
tgttaaaattgaa

SEQ ID NO: 731508 - DNA, 13 bp, C. elegans
tgttaaacaattt

SEQ ID NO: 731509 - DNA, 13 bp, C. elegans
tgttaaaggtgga

SEQ ID NO: 731510 - DNA, 13 bp, C. elegans
tgttaaataaatc

SEQ ID NO: 731511 - DNA, 13 bp, C. elegans
tgttaaatacaaa

SEQ ID NO: 731512 - DNA, 13 bp, C. elegans
tgttaaatattga

SEQ ID NO: 731513 - DNA, 13 bp, C. elegans
tgttaaatgttaa

SEQ ID NO: 731514 - DNA, 13 bp, C. elegans
tgttaaatttcaa

SEQ ID NO: 731515 - DNA, 13 bp, C. elegans
tgttaactttgaa

SEQ ID NO: 731516 - DNA, 13 bp, C. elegans
tgttaagtttttc

SEQ ID NO: 731517 - DNA, 13 bp, C. elegans
tgttaattcaaaa

SEQ ID NO: 731518 - DNA, 13 bp, C. elegans
tgttaattgataa

SEQ ID NO: 731519 - DNA, 13 bp, C. elegans
tgttaattgttaa

SEQ ID NO: 731520 - DNA, 13 bp, C. elegans
tgttaatttattc

SEQ ID NO: 731521 - DNA, 13 bp, C. elegans
tgttaatttttca

SEQ ID NO: 731522 - DNA, 13 bp, C. elegans
tgttacaaaatta

SEQ ID NO: 731523 - DNA, 13 bp, C. elegans
tgttactttttga

SEQ ID NO: 731524 - DNA, 13 bp, C. elegans
tgttagaaatgaa

SEQ ID NO: 731525 - DNA, 13 bp, C. elegans
tgttagatttcaa

SEQ ID NO: 731526 - DNA, 13 bp, C. elegans
tgttagttaacaa

SEQ ID NO: 731527 - DNA, 13 bp, C. elegans
tgttataaatttg

SEQ ID NO: 731528 - DNA, 13 bp, C. elegans
tgttatacatttt

SEQ ID NO: 731529 - DNA, 13 bp, C. elegans
tgttatcaaaaat

SEQ ID NO: 731530 - DNA, 13 bp, C. elegans
tgttatcaactat

SEQ ID NO: 731531 - DNA, 13 bp, C. elegans
tgttatcaattga

SEQ ID NO: 731532 - DNA, 13 bp, C. elegans
tgttatcagtttt

SEQ ID NO: 731533 - DNA, 13 bp, C. elegans
tgttatggaacat

SEQ ID NO: 731534 - DNA, 13 bp, C. elegans
tgttatgtaaaaa

SEQ ID NO: 731535 - DNA, 13 bp, C. elegans
tgttatgtattcg

SEQ ID NO: 731536 - DNA, 13 bp, C. elegans
tgttattcgattt

SEQ ID NO: 731537 - DNA, 13 bp, C. elegans
tgttattcgctca

SEQ ID NO: 731538 - DNA, 13 bp, C. elegans
tgttattgaaaat

SEQ ID NO: 731539 - DNA, 13 bp, C. elegans
tgttatttctagt

SEQ ID NO: 731540 - DNA, 13 bp, C. elegans
tgttattttcaaa

SEQ ID NO: 731541 - DNA, 13 bp, C. elegans
tgttattttctca

SEQ ID NO: 731542 - DNA, 13 bp, C. elegans
tgttcaaaaaaat

SEQ ID NO: 731543 - DNA, 13 bp, C. elegans
tgttcaaaaagtg

SEQ ID NO: 731544 - DNA, 13 bp, C. elegans
tgttcaaaaattt

SEQ ID NO: 731545 - DNA, 13 bp, C. elegans
tgttcaaaagttc

SEQ ID NO: 731546 - DNA, 13 bp, C. elegans
tgttcaaaataaa

SEQ ID NO: 731547 - DNA, 13 bp, C. elegans
tgttcaaaatcaa

SEQ ID NO: 731548 - DNA, 13 bp, C. elegans
tgttcaaaatgtg

SEQ ID NO: 731549 - DNA, 13 bp, C. elegans
tgttcaaacaaaa

SEQ ID NO: 731550 - DNA, 13 bp, C. elegans
tgttcaaacacgt

SEQ ID NO: 731551 - DNA, 13 bp, C. elegans
tgttcaaagattt

SEQ ID NO: 731552 - DNA, 13 bp, C. elegans
tgttcaaatagaa

SEQ ID NO: 731553 - DNA, 13 bp, C. elegans
tgttcaaatataa

SEQ ID NO: 731554 - DNA, 13 bp, C. elegans
tgttcaaatgaaa

SEQ ID NO: 731555 - DNA, 13 bp, C. elegans
tgttcaaatgatt

SEQ ID NO: 731556 - DNA, 13 bp, C. elegans
tgttcaaattgtt

SEQ ID NO: 731557 - DNA, 13 bp, C. elegans
tgttcaaatttca

SEQ ID NO: 731558 - DNA, 13 bp, C. elegans
tgttcaacagaaa

SEQ ID NO: 731559 - DNA, 13 bp, C. elegans
tgttcaaccaatt

SEQ ID NO: 731560 - DNA, 13 bp, C. elegans
tgttcaactacaa

SEQ ID NO: 731561 - DNA, 13 bp, C. elegans
tgttcaactttaa

SEQ ID NO: 731562 - DNA, 13 bp, C. elegans
tgttcaagaaaaa

SEQ ID NO: 731563 - DNA, 13 bp, C. elegans
tgttcaagaaatc

SEQ ID NO: 731564 - DNA, 13 bp, C. elegans
tgttcaagttttg

SEQ ID NO: 731565 - DNA, 13 bp, C. elegans
tgttcaataaaac

SEQ ID NO: 731566 - DNA, 13 bp, C. elegans
tgttcaatatttt

SEQ ID NO: 731567 - DNA, 13 bp, C. elegans
tgttcaatgaaca

SEQ ID NO: 731568 - DNA, 13 bp, C. elegans
tgttcaatgttta

SEQ ID NO: 731569 - DNA, 13 bp, C. elegans
tgttcaattattc

SEQ ID NO: 731570 - DNA, 13 bp, C. elegans
tgttcaattgaat

SEQ ID NO: 731571 - DNA, 13 bp, C. elegans
tgttcaattgttt

SEQ ID NO: 731572 - DNA, 13 bp, C. elegans
tgttcaatttcaa

SEQ ID NO: 731573 - DNA, 13 bp, C. elegans
tgttcaatttcgt

SEQ ID NO: 731574 - DNA, 13 bp, C. elegans
tgttcaatttctt

SEQ ID NO: 731575 - DNA, 13 bp, C. elegans
tgttcaatttgaa

SEQ ID NO: 731576 - DNA, 13 bp, C. elegans
tgttcaattttta

SEQ ID NO: 731577 - DNA, 13 bp, C. elegans
tgttcacaaattt

SEQ ID NO: 731578 - DNA, 13 bp, C. elegans
tgttcactaaaaa

SEQ ID NO: 731579 - DNA, 13 bp, C. elegans
tgttcactgtttc

SEQ ID NO: 731580 - DNA, 13 bp, C. elegans
tgttcacttttca

SEQ ID NO: 731581 - DNA, 13 bp, C. elegans
tgttcactttttg

SEQ ID NO: 731582 - DNA, 13 bp, C. elegans
tgttcagaaaaaa

SEQ ID NO: 731583 - DNA, 13 bp, C. elegans
tgttcagaaatgt

SEQ ID NO: 731584 - DNA, 13 bp, C. elegans
tgttcagaacatc

SEQ ID NO: 731585 - DNA, 13 bp, C. elegans
tgttcagaacttt

SEQ ID NO: 731586 - DNA, 13 bp, C. elegans
tgttcagaatttg

SEQ ID NO: 731587 - DNA, 13 bp, C. elegans
tgttcagttttca

SEQ ID NO: 731588 - DNA, 13 bp, C. elegans
tgttcataaaaaa

SEQ ID NO: 731589 - DNA, 13 bp, C. elegans
tgttcataatatt

SEQ ID NO: 731590 - DNA, 13 bp, C. elegans
tgttcatagtttt

SEQ ID NO: 731591 - DNA, 13 bp, C. elegans
tgttcatatattt

SEQ ID NO: 731592 - DNA, 13 bp, C. elegans
tgttcatattgtt

SEQ ID NO: 731593 - DNA, 13 bp, C. elegans
tgttcatgaaaat

SEQ ID NO: 731594 - DNA, 13 bp, C. elegans
tgttcattaattt

SEQ ID NO: 731595 - DNA, 13 bp, C. elegans
tgttcattcattt

SEQ ID NO: 731596 - DNA, 13 bp, C. elegans
tgttcatttaatt

SEQ ID NO: 731597 - DNA, 13 bp, C. elegans
tgttcattttata

SEQ ID NO: 731598 - DNA, 13 bp, C. elegans
tgttcatttttca

SEQ ID NO: 731599 - DNA, 13 bp, C. elegans
tgttccaaaaact

SEQ ID NO: 731600 - DNA, 13 bp, C. elegans
tgttccaaaaata

SEQ ID NO: 731601 - DNA, 13 bp, C. elegans
tgttccaaaaatt

SEQ ID NO: 731602 - DNA, 13 bp, C. elegans
tgttccaaaatta

SEQ ID NO: 731603 - DNA, 13 bp, C. elegans
tgttccaatattt

SEQ ID NO: 731604 - DNA, 13 bp, C. elegans
tgttccaatgttt

SEQ ID NO: 731605 - DNA, 13 bp, C. elegans
tgttccaattaaa

SEQ ID NO: 731606 - DNA, 13 bp, C. elegans
tgttccagatttt

SEQ ID NO: 731607 - DNA, 13 bp, C. elegans
tgttccatatttt

SEQ ID NO: 731608 - DNA, 13 bp, C. elegans
tgttccattttca

SEQ ID NO: 731609 - DNA, 13 bp, C. elegans
tgttccattttta

SEQ ID NO: 731610 - DNA, 13 bp, C. elegans
tgttcccaaaaat

SEQ ID NO: 731611 - DNA, 13 bp, C. elegans
tgttcccattttt

SEQ ID NO: 731612 - DNA, 13 bp, C. elegans
tgttcccgtaata

SEQ ID NO: 731613 - DNA, 13 bp, C. elegans
tgttccgacccct

SEQ ID NO: 731614 - DNA, 13 bp, C. elegans
tgttcctaaaaat

SEQ ID NO: 731615 - DNA, 13 bp, C. elegans
tgttcctaaaatt

SEQ ID NO: 731616 - DNA, 13 bp, C. elegans
tgttcctttaaaa

SEQ ID NO: 731617 - DNA, 13 bp, C. elegans
tgttcgaaattaa

SEQ ID NO: 731618 - DNA, 13 bp, C. elegans
tgttcgatggagc

SEQ ID NO: 731619 - DNA, 13 bp, C. elegans
tgttctaaaattt

SEQ ID NO: 731620 - DNA, 13 bp, C. elegans
tgttctaaattta

SEQ ID NO: 731621 - DNA, 13 bp, C. elegans
tgttctaaatttt

SEQ ID NO: 731622 - DNA, 13 bp, C. elegans
tgttctaactttt

SEQ ID NO: 731623 - DNA, 13 bp, C. elegans
tgttctattttca

SEQ ID NO: 731624 - DNA, 13 bp, C. elegans
tgttctcaatttt

SEQ ID NO: 731625 - DNA, 13 bp, C. elegans
tgttctcattttc

SEQ ID NO: 731626 - DNA, 13 bp, C. elegans
tgttctccaaaaa

SEQ ID NO: 731627 - DNA, 13 bp, C. elegans
tgttctcgaaaaa

SEQ ID NO: 731628 - DNA, 13 bp, C. elegans
tgttctctaaata

SEQ ID NO: 731629 - DNA, 13 bp, C. elegans
tgttctgaaaaac

SEQ ID NO: 731630 - DNA, 13 bp, C. elegans
tgttctgaaaata

SEQ ID NO: 731631 - DNA, 13 bp, C. elegans
tgttctgaaaatt

SEQ ID NO: 731632 - DNA, 13 bp, C. elegans
tgttctgatcctt

SEQ ID NO: 731633 - DNA, 13 bp, C. elegans
tgttctgtaattt

SEQ ID NO: 731634 - DNA, 14 bp, C. elegans
tgttctgtattcac

SEQ ID NO: 731635 - DNA, 13 bp, C. elegans
tgttctgttttca

SEQ ID NO: 731636 - DNA, 13 bp, C. elegans
tgttcttcaaaat

SEQ ID NO: 731637 - DNA, 13 bp, C. elegans
tgttcttcaaatc

SEQ ID NO: 731638 - DNA, 13 bp, C. elegans
tgttcttccaaaa

SEQ ID NO: 731639 - DNA, 13 bp, C. elegans
tgttcttcgaaaa

SEQ ID NO: 731640 - DNA, 13 bp, C. elegans
tgttgaaaaagaa

SEQ ID NO: 731641 - DNA, 13 bp, C. elegans
tgttgaaaaatcc

SEQ ID NO: 731642 - DNA, 13 bp, C. elegans
tgttgaaaactca

SEQ ID NO: 731643 - DNA, 13 bp, C. elegans
tgttgaaaataaa

SEQ ID NO: 731644 - DNA, 13 bp, C. elegans
tgttgaaaatagt

SEQ ID NO: 731645 - DNA, 13 bp, C. elegans
tgttgaaaatgtg

SEQ ID NO: 731646 - DNA, 13 bp, C. elegans
tgttgaaaattca

SEQ ID NO: 731647 - DNA, 13 bp, C. elegans
tgttgaaaattgt

SEQ ID NO: 731648 - DNA, 13 bp, C. elegans
tgttgaaaatttt

SEQ ID NO: 731649 - DNA, 13 bp, C. elegans
tgttgaaataaat

SEQ ID NO: 731650 - DNA, 13 bp, C. elegans
tgttgaaatgaaa

SEQ ID NO: 731651 - DNA, 13 bp, C. elegans
tgttgaaattaaa

SEQ ID NO: 731652 - DNA, 13 bp, C. elegans
tgttgaaattgga

SEQ ID NO: 731653 - DNA, 13 bp, C. elegans
tgttgaaatttta

SEQ ID NO: 731654 - DNA, 13 bp, C. elegans
tgttgaatgaatc

SEQ ID NO: 731655 - DNA, 13 bp, C. elegans
tgttgaattgaat

SEQ ID NO: 731656 - DNA, 13 bp, C. elegans
tgttgaatttaaa

SEQ ID NO: 731657 - DNA, 13 bp, C. elegans
tgttgacaatatt

SEQ ID NO: 731658 - DNA, 13 bp, C. elegans
tgttgacattttg

SEQ ID NO: 731659 - DNA, 13 bp, C. elegans
tgttgacgtcaca

SEQ ID NO: 731660 - DNA, 13 bp, C. elegans
tgttgagttatga

SEQ ID NO: 731661 - DNA, 13 bp, C. elegans
tgttgatattttc

SEQ ID NO: 731662 - DNA, 13 bp, C. elegans
tgttgatgatgat

SEQ ID NO: 731663 - DNA, 13 bp, C. elegans
tgttgattcaaaa

SEQ ID NO: 731664 - DNA, 13 bp, C. elegans
tgttgatttacga

SEQ ID NO: 731665 - DNA, 13 bp, C. elegans
tgttgatttttgc

SEQ ID NO: 731666 - DNA, 13 bp, C. elegans
tgttgcaaaaaca

SEQ ID NO: 731667 - DNA, 13 bp, C. elegans
tgttgcaaaactt

SEQ ID NO: 731668 - DNA, 13 bp, C. elegans
tgttgcaaaattc

SEQ ID NO: 731669 - DNA, 13 bp, C. elegans
tgttgcaaatttt

SEQ ID NO: 731670 - DNA, 13 bp, C. elegans
tgttgcaataaat

SEQ ID NO: 731671 - DNA, 13 bp, C. elegans
tgttgcattttct

SEQ ID NO: 731672 - DNA, 13 bp, C. elegans
tgttgccaaaaag

SEQ ID NO: 731673 - DNA, 13 bp, C. elegans
tgttgctaaaatt

SEQ ID NO: 731674 - DNA, 13 bp, C. elegans
tgttgctattaat

SEQ ID NO: 731675 - DNA, 13 bp, C. elegans
tgttgctgcggaa

SEQ ID NO: 731676 - DNA, 13 bp, C. elegans
tgttggaaaaaaa

SEQ ID NO: 731677 - DNA, 13 bp, C. elegans
tgttggaaaacat

SEQ ID NO: 731678 - DNA, 13 bp, C. elegans
tgttggaattgaa

SEQ ID NO: 731679 - DNA, 13 bp, C. elegans
tgttggattttca

SEQ ID NO: 731680 - DNA, 13 bp, C. elegans
tgttgtaaattta

SEQ ID NO: 731681 - DNA, 13 bp, C. elegans
tgttgtaatttga

SEQ ID NO: 731682 - DNA, 13 bp, C. elegans
tgttgtacatttt

SEQ ID NO: 731683 - DNA, 13 bp, C. elegans
tgttgtcaattta

SEQ ID NO: 731684 - DNA, 13 bp, C. elegans
tgttgtccttgtc

SEQ ID NO: 731685 - DNA, 13 bp, C. elegans
tgttgtgaaaatt

SEQ ID NO: 731686 - DNA, 13 bp, C. elegans
tgttgtgacttgg

SEQ ID NO: 731687 - DNA, 16 bp, C. elegans
tgttgtggacggaacg

SEQ ID NO: 731688 - DNA, 19 bp, C. elegans
tgttgtggacggaacgtaa

SEQ ID NO: 731689 - DNA, 13 bp, C. elegans
tgttgttaaatta

SEQ ID NO: 731690 - DNA, 13 bp, C. elegans
tgttgttctcatt

SEQ ID NO: 731691 - DNA, 13 bp, C. elegans
tgttgttttacaa

SEQ ID NO: 731692 - DNA, 13 bp, C. elegans
tgttgttttcaaa

SEQ ID NO: 731693 - DNA, 13 bp, C. elegans
tgttgttttctga

SEQ ID NO: 731694 - DNA, 13 bp, C. elegans
tgttgtttttcaa

SEQ ID NO: 731695 - DNA, 13 bp, C. elegans
tgtttaaaatgtt

SEQ ID NO: 731696 - DNA, 13 bp, C. elegans
tgtttaaaattcg

SEQ ID NO: 731697 - DNA, 13 bp, C. elegans
tgtttaaactatt

SEQ ID NO: 731698 - DNA, 13 bp, C. elegans
tgtttaaagtatt

SEQ ID NO: 731699 - DNA, 13 bp, C. elegans
tgtttaactttta

SEQ ID NO: 731700 - DNA, 13 bp, C. elegans
tgtttaagaattt

SEQ ID NO: 731701 - DNA, 13 bp, C. elegans
tgtttaatttctg

SEQ ID NO: 731702 - DNA, 13 bp, C. elegans
tgtttacaaaaac

SEQ ID NO: 731703 - DNA, 13 bp, C. elegans
tgtttacagaaaa

SEQ ID NO: 731704 - DNA, 13 bp, C. elegans
tgtttactgtttc

SEQ ID NO: 731705 - DNA, 13 bp, C. elegans
tgtttagagaaaa

SEQ ID NO: 731706 - DNA, 13 bp, C. elegans
tgtttagagcaaa

SEQ ID NO: 731707 - DNA, 13 bp, C. elegans
tgtttatattcaa

SEQ ID NO: 731708 - DNA, 13 bp, C. elegans
tgtttatcaaaaa

SEQ ID NO: 731709 - DNA, 13 bp, C. elegans
tgtttatcaattt

SEQ ID NO: 731710 - DNA, 13 bp, C. elegans
tgtttatttgaaa

SEQ ID NO: 731711 - DNA, 13 bp, C. elegans
tgtttatttggaa

SEQ ID NO: 731712 - DNA, 13 bp, C. elegans
tgtttcaaaaaaa

SEQ ID NO: 731713 - DNA, 13 bp, C. elegans
tgtttcaaaaaac

SEQ ID NO: 731714 - DNA, 13 bp, C. elegans
tgtttcaaaacca

SEQ ID NO: 731715 - DNA, 13 bp, C. elegans
tgtttcaaaagtt

SEQ ID NO: 731716 - DNA, 13 bp, C. elegans
tgtttcaaactta

SEQ ID NO: 731717 - DNA, 13 bp, C. elegans
tgtttcaaagtgt

SEQ ID NO: 731718 - DNA, 13 bp, C. elegans
tgtttcaaataaa

SEQ ID NO: 731719 - DNA, 13 bp, C. elegans
tgtttcaaataat

SEQ ID NO: 731720 - DNA, 13 bp, C. elegans
tgtttcaaatatt

SEQ ID NO: 731721 - DNA, 13 bp, C. elegans
tgtttcaaattgt

SEQ ID NO: 731722 - DNA, 13 bp, C. elegans
tgtttcaacaaat

SEQ ID NO: 731723 - DNA, 13 bp, C. elegans
tgtttcaagattt

SEQ ID NO: 731724 - DNA, 13 bp, C. elegans
tgtttcaagttgt

SEQ ID NO: 731725 - DNA, 13 bp, C. elegans
tgtttcaagttta

SEQ ID NO: 731726 - DNA, 13 bp, C. elegans
tgtttcaagtttt

SEQ ID NO: 731727 - DNA, 13 bp, C. elegans
tgtttcaataagt

SEQ ID NO: 731728 - DNA, 13 bp, C. elegans
tgtttcaatgaat

SEQ ID NO: 731729 - DNA, 13 bp, C. elegans
tgtttcaatgatt

SEQ ID NO: 731730 - DNA, 13 bp, C. elegans
tgtttcaatgtgt

SEQ ID NO: 731731 - DNA, 13 bp, C. elegans
tgtttcaatgttt

SEQ ID NO: 731732 - DNA, 13 bp, C. elegans
tgtttcaattgaa

SEQ ID NO: 731733 - DNA, 13 bp, C. elegans
tgtttcaattgtt

SEQ ID NO: 731734 - DNA, 13 bp, C. elegans
tgtttcaatttaa

SEQ ID NO: 731735 - DNA, 13 bp, C. elegans
tgtttcacaaaat

SEQ ID NO: 731736 - DNA, 13 bp, C. elegans
tgtttcacaaact

SEQ ID NO: 731737 - DNA, 13 bp, C. elegans
tgtttcacataaa

SEQ ID NO: 731738 - DNA, 13 bp, C. elegans
tgtttcacattta

SEQ ID NO: 731739 - DNA, 13 bp, C. elegans
tgtttcactaatt

SEQ ID NO: 731740 - DNA, 13 bp, C. elegans
tgtttcagaaaaa

SEQ ID NO: 731741 - DNA, 13 bp, C. elegans
tgtttcagaaatt

SEQ ID NO: 731742 - DNA, 13 bp, C. elegans
tgtttcagaacat

SEQ ID NO: 731743 - DNA, 13 bp, C. elegans
tgtttcagaattt

SEQ ID NO: 731744 - DNA, 13 bp, C. elegans
tgtttcagcacct

SEQ ID NO: 731745 - DNA, 13 bp, C. elegans
tgtttcataaata

SEQ ID NO: 731746 - DNA, 13 bp, C. elegans
tgtttcataaatt

SEQ ID NO: 731747 - DNA, 13 bp, C. elegans
tgtttcatacatt

SEQ ID NO: 731748 - DNA, 13 bp, C. elegans
tgtttcatattat

SEQ ID NO: 731749 - DNA, 13 bp, C. elegans
tgtttcatattca

SEQ ID NO: 731750 - DNA, 13 bp, C. elegans
tgtttcatcaatt

SEQ ID NO: 731751 - DNA, 13 bp, C. elegans
tgtttcatgattt

SEQ ID NO: 731752 - DNA, 13 bp, C. elegans
tgtttcattaaaa

SEQ ID NO: 731753 - DNA, 13 bp, C. elegans
tgtttccaaaaaa

SEQ ID NO: 731754 - DNA, 13 bp, C. elegans
tgtttccaagttt

SEQ ID NO: 731755 - DNA, 13 bp, C. elegans
tgtttccaatttt

SEQ ID NO: 731756 - DNA, 13 bp, C. elegans
tgtttccatcttt

SEQ ID NO: 731757 - DNA, 13 bp, C. elegans
tgtttccattttc

SEQ ID NO: 731758 - DNA, 13 bp, C. elegans
tgtttcccaattt

SEQ ID NO: 731759 - DNA, 13 bp, C. elegans
tgtttcccatttt

SEQ ID NO: 731760 - DNA, 13 bp, C. elegans
tgtttcccgttct

SEQ ID NO: 731761 - DNA, 13 bp, C. elegans
tgtttcgaagttt

SEQ ID NO: 731762 - DNA, 16 bp, C. elegans
tgtttcgactgtgtag

SEQ ID NO: 731763 - DNA, 13 bp, C. elegans
tgtttcgtttcaa

SEQ ID NO: 731764 - DNA, 13 bp, C. elegans
tgtttctaaaaaa

SEQ ID NO: 731765 - DNA, 13 bp, C. elegans
tgtttctaaaata

SEQ ID NO: 731766 - DNA, 13 bp, C. elegans
tgtttctaaaatt

SEQ ID NO: 731767 - DNA, 13 bp, C. elegans
tgtttctaaattt

SEQ ID NO: 731768 - DNA, 13 bp, C. elegans
tgtttctaattgt

SEQ ID NO: 731769 - DNA, 13 bp, C. elegans
tgtttctcatttc

SEQ ID NO: 731770 - DNA, 13 bp, C. elegans
tgtttctctaatt

SEQ ID NO: 731771 - DNA, 13 bp, C. elegans
tgtttctgaattt

SEQ ID NO: 731772 - DNA, 13 bp, C. elegans
tgtttctggaatt

SEQ ID NO: 731773 - DNA, 13 bp, C. elegans
tgtttcttaaaaa

SEQ ID NO: 731774 - DNA, 13 bp, C. elegans
tgtttcttcaaat

SEQ ID NO: 731775 - DNA, 13 bp, C. elegans
tgtttcttcaatt

SEQ ID NO: 731776 - DNA, 13 bp, C. elegans
tgtttgaaaaaaa

SEQ ID NO: 731777 - DNA, 13 bp, C. elegans
tgtttgaaaatgt

SEQ ID NO: 731778 - DNA, 13 bp, C. elegans
tgtttgaaaattg

SEQ ID NO: 731779 - DNA, 13 bp, C. elegans
tgtttgaaacttg

SEQ ID NO: 731780 - DNA, 13 bp, C. elegans
tgtttgaaagtga

SEQ ID NO: 731781 - DNA, 13 bp, C. elegans
tgtttgaaattat

SEQ ID NO: 731782 - DNA, 13 bp, C. elegans
tgtttgaattaat

SEQ ID NO: 731783 - DNA, 13 bp, C. elegans
tgtttgaattttc

SEQ ID NO: 731784 - DNA, 13 bp, C. elegans
tgtttgataacat

SEQ ID NO: 731785 - DNA, 13 bp, C. elegans
tgtttgattccaa

SEQ ID NO: 731786 - DNA, 13 bp, C. elegans
tgtttgatttaaa

SEQ ID NO: 731787 - DNA, 13 bp, C. elegans
tgtttgatttgaa

SEQ ID NO: 731788 - DNA, 13 bp, C. elegans
tgtttgcaaatat

SEQ ID NO: 731789 - DNA, 13 bp, C. elegans
tgtttgcaaattt

SEQ ID NO: 731790 - DNA, 13 bp, C. elegans
tgtttgcacaaaa

SEQ ID NO: 731791 - DNA, 13 bp, C. elegans
tgtttgcacaaat

SEQ ID NO: 731792 - DNA, 13 bp, C. elegans
tgtttgcagtttt

SEQ ID NO: 731793 - DNA, 13 bp, C. elegans
tgtttgcctttcg

SEQ ID NO: 731794 - DNA, 14 bp, C. elegans
tgtttgcggacttt

SEQ ID NO: 731795 - DNA, 13 bp, C. elegans
tgtttgcgtacct

SEQ ID NO: 731796 - DNA, 13 bp, C. elegans
tgtttgctgaaaa

SEQ ID NO: 731797 - DNA, 13 bp, C. elegans
tgtttggaaattt

SEQ ID NO: 731798 - DNA, 13 bp, C. elegans
tgtttggaatgtt

SEQ ID NO: 731799 - DNA, 14 bp, C. elegans
tgtttggtccgcaa

SEQ ID NO: 731800 - DNA, 13 bp, C. elegans
tgtttgtgagaaa

SEQ ID NO: 731801 - DNA, 13 bp, C. elegans
tgtttgttaaaaa

SEQ ID NO: 731802 - DNA, 13 bp, C. elegans
tgtttgttaaaat

SEQ ID NO: 731803 - DNA, 13 bp, C. elegans
tgtttgttggaaa

SEQ ID NO: 731804 - DNA, 13 bp, C. elegans
tgttttaaaacta

SEQ ID NO: 731805 - DNA, 13 bp, C. elegans
tgttttaaagaaa

SEQ ID NO: 731806 - DNA, 13 bp, C. elegans
tgttttaaagcat

SEQ ID NO: 731807 - DNA, 13 bp, C. elegans
tgttttaaattga

SEQ ID NO: 731808 - DNA, 13 bp, C. elegans
tgttttaataaac

SEQ ID NO: 731809 - DNA, 13 bp, C. elegans
tgttttaatcaaa

SEQ ID NO: 731810 - DNA, 13 bp, C. elegans
tgttttaatcaat

SEQ ID NO: 731811 - DNA, 13 bp, C. elegans
tgttttaatgaac

SEQ ID NO: 731812 - DNA, 13 bp, C. elegans
tgttttacaaaac

SEQ ID NO: 731813 - DNA, 13 bp, C. elegans
tgttttactactt

SEQ ID NO: 731814 - DNA, 13 bp, C. elegans
tgttttagtcatt

SEQ ID NO: 731815 - DNA, 13 bp, C. elegans
tgttttatagaaa

SEQ ID NO: 731816 - DNA, 13 bp, C. elegans
tgttttatatgaa

SEQ ID NO: 731817 - DNA, 13 bp, C. elegans
tgttttatcagtt

SEQ ID NO: 731818 - DNA, 13 bp, C. elegans
tgttttatgaaaa

SEQ ID NO: 731819 - DNA, 13 bp, C. elegans
tgttttatgatga

SEQ ID NO: 731820 - DNA, 13 bp, C. elegans
tgttttattacaa

SEQ ID NO: 731821 - DNA, 13 bp, C. elegans
tgttttattcgaa

SEQ ID NO: 731822 - DNA, 13 bp, C. elegans
tgttttatttcaa

SEQ ID NO: 731823 - DNA, 14 bp, C. elegans
tgttttcaaaaaaa

SEQ ID NO: 731824 - DNA, 13 bp, C. elegans
tgttttcaaaatg

SEQ ID NO: 731825 - DNA, 13 bp, C. elegans
tgttttcaaagaa

SEQ ID NO: 731826 - DNA, 13 bp, C. elegans
tgttttcaaatgt

SEQ ID NO: 731827 - DNA, 13 bp, C. elegans
tgttttcaaatta

SEQ ID NO: 731828 - DNA, 13 bp, C. elegans
tgttttcaacaaa

SEQ ID NO: 731829 - DNA, 13 bp, C. elegans
tgttttcaacatt

SEQ ID NO: 731830 - DNA, 13 bp, C. elegans
tgttttcaagaat

SEQ ID NO: 731831 - DNA, 13 bp, C. elegans
tgttttcaatcat

SEQ ID NO: 731832 - DNA, 13 bp, C. elegans
tgttttcaattct

SEQ ID NO: 731833 - DNA, 13 bp, C. elegans
tgttttcagaaaa

SEQ ID NO: 731834 - DNA, 13 bp, C. elegans
tgttttcagacaa

SEQ ID NO: 731835 - DNA, 13 bp, C. elegans
tgttttcagagaa

SEQ ID NO: 731836 - DNA, 13 bp, C. elegans
tgttttcataaaa

SEQ ID NO: 731837 - DNA, 13 bp, C. elegans
tgttttcattgat

SEQ ID NO: 731838 - DNA, 13 bp, C. elegans
tgttttcccattg

SEQ ID NO: 731839 - DNA, 13 bp, C. elegans
tgttttccgcgtg

SEQ ID NO: 731840 - DNA, 13 bp, C. elegans
tgttttcctacat

SEQ ID NO: 731841 - DNA, 13 bp, C. elegans
tgttttcggaaaa

SEQ ID NO: 731842 - DNA, 13 bp, C. elegans
tgttttctaaatt

SEQ ID NO: 731843 - DNA, 13 bp, C. elegans
tgttttctaatat

SEQ ID NO: 731844 - DNA, 13 bp, C. elegans
tgttttctacatt

SEQ ID NO: 731845 - DNA, 13 bp, C. elegans
tgttttctaggcc

SEQ ID NO: 731846 - DNA, 13 bp, C. elegans
tgttttctcaaaa

SEQ ID NO: 731847 - DNA, 13 bp, C. elegans
tgttttctcaatt

SEQ ID NO: 731848 - DNA, 13 bp, C. elegans
tgttttctccaaa

SEQ ID NO: 731849 - DNA, 13 bp, C. elegans
tgttttctgaaaa

SEQ ID NO: 731850 - DNA, 13 bp, C. elegans
tgttttctgacat

SEQ ID NO: 731851 - DNA, 13 bp, C. elegans
tgttttctgatac

SEQ ID NO: 731852 - DNA, 13 bp, C. elegans
tgttttctttaaa

SEQ ID NO: 731853 - DNA, 13 bp, C. elegans
tgttttctttgaa

SEQ ID NO: 731854 - DNA, 13 bp, C. elegans
tgttttgaaaaag

SEQ ID NO: 731855 - DNA, 13 bp, C. elegans
tgttttgaaaata

SEQ ID NO: 731856 - DNA, 13 bp, C. elegans
tgttttgaaaatt

SEQ ID NO: 731857 - DNA, 13 bp, C. elegans
tgttttgaaacaa

SEQ ID NO: 731858 - DNA, 13 bp, C. elegans
tgttttgaaacag

SEQ ID NO: 731859 - DNA, 13 bp, C. elegans
tgttttgaaacat

SEQ ID NO: 731860 - DNA, 13 bp, C. elegans
tgttttgaaatcg

SEQ ID NO: 731861 - DNA, 13 bp, C. elegans
tgttttgaagaaa

SEQ ID NO: 731862 - DNA, 13 bp, C. elegans
tgttttgaataaa

SEQ ID NO: 731863 - DNA, 13 bp, C. elegans
tgttttgaataat

SEQ ID NO: 731864 - DNA, 13 bp, C. elegans
tgttttgacaatt

SEQ ID NO: 731865 - DNA, 13 bp, C. elegans
tgttttgatcaaa

SEQ ID NO: 731866 - DNA, 13 bp, C. elegans
tgttttgcaaagt

SEQ ID NO: 731867 - DNA, 13 bp, C. elegans
tgttttggaataa

SEQ ID NO: 731868 - DNA, 13 bp, C. elegans
tgttttgtacatt

SEQ ID NO: 731869 - DNA, 13 bp, C. elegans
tgttttgtgatga

SEQ ID NO: 731870 - DNA, 13 bp, C. elegans
tgttttgttgaaa

SEQ ID NO: 731871 - DNA, 13 bp, C. elegans
tgtttttaaaaac

SEQ ID NO: 731872 - DNA, 13 bp, C. elegans
tgtttttaacaaa

SEQ ID NO: 731873 - DNA, 13 bp, C. elegans
tgtttttaactat

SEQ ID NO: 731874 - DNA, 13 bp, C. elegans
tgtttttacaaaa

SEQ ID NO: 731875 - DNA, 13 bp, C. elegans
tgtttttatatac

SEQ ID NO: 731876 - DNA, 13 bp, C. elegans
tgtttttatatca

SEQ ID NO: 731877 - DNA, 13 bp, C. elegans
tgtttttcaaaaa

SEQ ID NO: 731878 - DNA, 13 bp, C. elegans
tgtttttcaaatt

SEQ ID NO: 731879 - DNA, 13 bp, C. elegans
tgtttttcaatgt

SEQ ID NO: 731880 - DNA, 13 bp, C. elegans
tgtttttcactga

SEQ ID NO: 731881 - DNA, 13 bp, C. elegans
tgtttttcagctt

SEQ ID NO: 731882 - DNA, 13 bp, C. elegans
tgtttttcggaaa

SEQ ID NO: 731883 - DNA, 13 bp, C. elegans
tgtttttcggtga

SEQ ID NO: 731884 - DNA, 13 bp, C. elegans
tgtttttcgtgaa

SEQ ID NO: 731885 - DNA, 13 bp, C. elegans
tgtttttctaaat

SEQ ID NO: 731886 - DNA, 13 bp, C. elegans
tgtttttctcact

SEQ ID NO: 731887 - DNA, 13 bp, C. elegans
tgtttttctgtga

SEQ ID NO: 731888 - DNA, 13 bp, C. elegans
tgtttttgaatca

SEQ ID NO: 731889 - DNA, 13 bp, C. elegans
tgtttttgaatga

SEQ ID NO: 731890 - DNA, 13 bp, C. elegans
tgtttttgcaaaa

SEQ ID NO: 731891 - DNA, 13 bp, C. elegans
tgtttttggcaaa

SEQ ID NO: 731892 - DNA, 13 bp, C. elegans
tgtttttgtaact

SEQ ID NO: 731893 - DNA, 13 bp, C. elegans
tgtttttgtggaa

SEQ ID NO: 731894 - DNA, 13 bp, C. elegans
tgtttttgttcac

SEQ ID NO: 731895 - DNA, 13 bp, C. elegans
tgttttttaaaac

SEQ ID NO: 731896 - DNA, 13 bp, C. elegans
tgttttttaaatc

SEQ ID NO: 731897 - DNA, 13 bp, C. elegans
tgttttttatcag

SEQ ID NO: 731898 - DNA, 13 bp, C. elegans
tgttttttcaaat

SEQ ID NO: 731899 - DNA, 13 bp, C. elegans
tgttttttcgaaa

SEQ ID NO: 731900 - DNA, 13 bp, C. elegans
tgttttttctaac

SEQ ID NO: 731901 - DNA, 13 bp, C. elegans
tgttttttgaact

SEQ ID NO: 731902 - DNA, 13 bp, C. elegans
tgttttttgcaaa

SEQ ID NO: 731903 - DNA, 13 bp, C. elegans
tgtttttttaaca

SEQ ID NO: 731904 - DNA, 13 bp, C. elegans
tgtttttttacaa

SEQ ID NO: 731905 - DNA, 13 bp, C. elegans
tgtttttttccga

SEQ ID NO: 731906 - DNA, 13 bp, C. elegans
tgtttttttgcca

SEQ ID NO: 731907 - DNA, 13 bp, C. elegans
ttaaaaaaaactg

SEQ ID NO: 731908 - DNA, 13 bp, C. elegans
ttaaaaaaatcga

SEQ ID NO: 731909 - DNA, 13 bp, C. elegans
ttaaaaaacattc

SEQ ID NO: 731910 - DNA, 13 bp, C. elegans
ttaaaaaaccaga

SEQ ID NO: 731911 - DNA, 13 bp, C. elegans
ttaaaaaactatc

SEQ ID NO: 731912 - DNA, 13 bp, C. elegans
ttaaaaaactctt

SEQ ID NO: 731913 - DNA, 13 bp, C. elegans
ttaaaaaagtaca

SEQ ID NO: 731914 - DNA, 13 bp, C. elegans
ttaaaaaagtgta

SEQ ID NO: 731915 - DNA, 13 bp, C. elegans
ttaaaaaatccat

SEQ ID NO: 731916 - DNA, 13 bp, C. elegans
ttaaaaaatcgga

SEQ ID NO: 731917 - DNA, 13 bp, C. elegans
ttaaaaaatcgtg

SEQ ID NO: 731918 - DNA, 13 bp, C. elegans
ttaaaaaatgcag

SEQ ID NO: 731919 - DNA, 13 bp, C. elegans
ttaaaaaatgctt

SEQ ID NO: 731920 - DNA, 13 bp, C. elegans
ttaaaaaatgtac

SEQ ID NO: 731921 - DNA, 13 bp, C. elegans
ttaaaaacctttt

SEQ ID NO: 731922 - DNA, 13 bp, C. elegans
ttaaaaacgaaat

SEQ ID NO: 731923 - DNA, 13 bp, C. elegans
ttaaaaactactc

SEQ ID NO: 731924 - DNA, 13 bp, C. elegans
ttaaaaactagaa

SEQ ID NO: 731925 - DNA, 13 bp, C. elegans
ttaaaaactattc

SEQ ID NO: 731926 - DNA, 13 bp, C. elegans
ttaaaaactcatt

SEQ ID NO: 731927 - DNA, 13 bp, C. elegans
ttaaaaactgcaa

SEQ ID NO: 731928 - DNA, 13 bp, C. elegans
ttaaaaactggaa

SEQ ID NO: 731929 - DNA, 13 bp, C. elegans
ttaaaaactgtta

SEQ ID NO: 731930 - DNA, 13 bp, C. elegans
ttaaaaacttaca

SEQ ID NO: 731931 - DNA, 13 bp, C. elegans
ttaaaaacttctt

SEQ ID NO: 731932 - DNA, 13 bp, C. elegans
ttaaaaacttttc

SEQ ID NO: 731933 - DNA, 13 bp, C. elegans
ttaaaaagagatt

SEQ ID NO: 731934 - DNA, 13 bp, C. elegans
ttaaaaagctgaa

SEQ ID NO: 731935 - DNA, 13 bp, C. elegans
ttaaaaagctttt

SEQ ID NO: 731936 - DNA, 13 bp, C. elegans
ttaaaaaggtttt

SEQ ID NO: 731937 - DNA, 13 bp, C. elegans
ttaaaaagtgata

SEQ ID NO: 731938 - DNA, 13 bp, C. elegans
ttaaaaagtggca

SEQ ID NO: 731939 - DNA, 13 bp, C. elegans
ttaaaaagtgtaa

SEQ ID NO: 731940 - DNA, 13 bp, C. elegans
ttaaaaatacaga

SEQ ID NO: 731941 - DNA, 13 bp, C. elegans
ttaaaaatcattc

SEQ ID NO: 731942 - DNA, 13 bp, C. elegans
ttaaaaatccaag

SEQ ID NO: 731943 - DNA, 13 bp, C. elegans
ttaaaaatcgata

SEQ ID NO: 731944 - DNA, 13 bp, C. elegans
ttaaaaatctcaa

SEQ ID NO: 731945 - DNA, 13 bp, C. elegans
ttaaaaatgaact

SEQ ID NO: 731946 - DNA, 13 bp, C. elegans
ttaaaaatgatgt

SEQ ID NO: 731947 - DNA, 13 bp, C. elegans
ttaaaaatgcatt

SEQ ID NO: 731948 - DNA, 13 bp, C. elegans
ttaaaaatgcctt

SEQ ID NO: 731949 - DNA, 13 bp, C. elegans
ttaaaaatgctca

SEQ ID NO: 731950 - DNA, 13 bp, C. elegans
ttaaaaatggaag

SEQ ID NO: 731951 - DNA, 13 bp, C. elegans
ttaaaaatgtatg

SEQ ID NO: 731952 - DNA, 13 bp, C. elegans
ttaaaaattactc

SEQ ID NO: 731953 - DNA, 13 bp, C. elegans
ttaaaaattccaa

SEQ ID NO: 731954 - DNA, 13 bp, C. elegans
ttaaaaattcgat

SEQ ID NO: 731955 - DNA, 13 bp, C. elegans
ttaaaaattctga

SEQ ID NO: 731956 - DNA, 13 bp, C. elegans
ttaaaaatttcag

SEQ ID NO: 731957 - DNA, 13 bp, C. elegans
ttaaaaatttctg

SEQ ID NO: 731958 - DNA, 13 bp, C. elegans
ttaaaaattttgc

SEQ ID NO: 731959 - DNA, 13 bp, C. elegans
ttaaaacaaattc

SEQ ID NO: 731960 - DNA, 13 bp, C. elegans
ttaaaacaactat

SEQ ID NO: 731961 - DNA, 13 bp, C. elegans
ttaaaacaatcta

SEQ ID NO: 731962 - DNA, 13 bp, C. elegans
ttaaaacaattgt

SEQ ID NO: 731963 - DNA, 13 bp, C. elegans
ttaaaacaatttc

SEQ ID NO: 731964 - DNA, 13 bp, C. elegans
ttaaaacaatttg

SEQ ID NO: 731965 - DNA, 13 bp, C. elegans
ttaaaacagtatt

SEQ ID NO: 731966 - DNA, 13 bp, C. elegans
ttaaaacagtttt

SEQ ID NO: 731967 - DNA, 13 bp, C. elegans
ttaaaacattcta

SEQ ID NO: 731968 - DNA, 13 bp, C. elegans
ttaaaacattgta

SEQ ID NO: 731969 - DNA, 13 bp, C. elegans
ttaaaacattttc

SEQ ID NO: 731970 - DNA, 13 bp, C. elegans
ttaaaaccagaaa

SEQ ID NO: 731971 - DNA, 13 bp, C. elegans
ttaaaaccgaaaa

SEQ ID NO: 731972 - DNA, 13 bp, C. elegans
ttaaaaccttaaa

SEQ ID NO: 731973 - DNA, 13 bp, C. elegans
ttaaaacgttgaa

SEQ ID NO: 731974 - DNA, 13 bp, C. elegans
ttaaaactactcc

SEQ ID NO: 731975 - DNA, 13 bp, C. elegans
ttaaaactcagaa

SEQ ID NO: 731976 - DNA, 13 bp, C. elegans
ttaaaactctgaa

SEQ ID NO: 731977 - DNA, 13 bp, C. elegans
ttaaaactgaaat

SEQ ID NO: 731978 - DNA, 13 bp, C. elegans
ttaaaactgattt

SEQ ID NO: 731979 - DNA, 13 bp, C. elegans
ttaaaacttacaa

SEQ ID NO: 731980 - DNA, 13 bp, C. elegans
ttaaaacttcact

SEQ ID NO: 731981 - DNA, 13 bp, C. elegans
ttaaaactttcta

SEQ ID NO: 731982 - DNA, 13 bp, C. elegans
ttaaaacttttga

SEQ ID NO: 731983 - DNA, 13 bp, C. elegans
ttaaaagcaaatt

SEQ ID NO: 731984 - DNA, 13 bp, C. elegans
ttaaaagctaaaa

SEQ ID NO: 731985 - DNA, 13 bp, C. elegans
ttaaaagtagcca

SEQ ID NO: 731986 - DNA, 13 bp, C. elegans
ttaaaagtccaaa

SEQ ID NO: 731987 - DNA, 13 bp, C. elegans
ttaaaagtgattt

SEQ ID NO: 731988 - DNA, 13 bp, C. elegans
ttaaaagtggagt

SEQ ID NO: 731989 - DNA, 13 bp, C. elegans
ttaaaagttatgt

SEQ ID NO: 731990 - DNA, 13 bp, C. elegans
ttaaaagttgtta

SEQ ID NO: 731991 - DNA, 13 bp, C. elegans
ttaaaagttgttt

SEQ ID NO: 731992 - DNA, 13 bp, C. elegans
ttaaaagtttgta

SEQ ID NO: 731993 - DNA, 13 bp, C. elegans
ttaaaataaaagc

SEQ ID NO: 731994 - DNA, 13 bp, C. elegans
ttaaaataatgca

SEQ ID NO: 731995 - DNA, 13 bp, C. elegans
ttaaaatacatgt

SEQ ID NO: 731996 - DNA, 13 bp, C. elegans
ttaaaatcacgaa

SEQ ID NO: 731997 - DNA, 13 bp, C. elegans
ttaaaatcagttt

SEQ ID NO: 731998 - DNA, 13 bp, C. elegans
ttaaaatcgcaaa

SEQ ID NO: 731999 - DNA, 13 bp, C. elegans
ttaaaatcgtttt

SEQ ID NO: 732000 - DNA, 13 bp, C. elegans
ttaaaatgaaagt

SEQ ID NO: 732001 - DNA, 13 bp, C. elegans
ttaaaatgatact

SEQ ID NO: 732002 - DNA, 13 bp, C. elegans
ttaaaatgattga

SEQ ID NO: 732003 - DNA, 13 bp, C. elegans
ttaaaatgcaaat

SEQ ID NO: 732004 - DNA, 13 bp, C. elegans
ttaaaatgctcaa

SEQ ID NO: 732005 - DNA, 13 bp, C. elegans
ttaaaatggaaga

SEQ ID NO: 732006 - DNA, 13 bp, C. elegans
ttaaaatgtgttt

SEQ ID NO: 732007 - DNA, 13 bp, C. elegans
ttaaaatgttgaa

SEQ ID NO: 732008 - DNA, 13 bp, C. elegans
ttaaaatgttgat

SEQ ID NO: 732009 - DNA, 13 bp, C. elegans
ttaaaatgttgta

SEQ ID NO: 732010 - DNA, 13 bp, C. elegans
ttaaaatgtttag

SEQ ID NO: 732011 - DNA, 13 bp, C. elegans
ttaaaatgtttct

SEQ ID NO: 732012 - DNA, 13 bp, C. elegans
ttaaaattccgcc

SEQ ID NO: 732013 - DNA, 13 bp, C. elegans
ttaaaattctgaa

SEQ ID NO: 732014 - DNA, 13 bp, C. elegans
ttaaaattcttct

SEQ ID NO: 732015 - DNA, 13 bp, C. elegans
ttaaaattgaagc

SEQ ID NO: 732016 - DNA, 13 bp, C. elegans
ttaaaattgagca

SEQ ID NO: 732017 - DNA, 13 bp, C. elegans
ttaaaattgccaa

SEQ ID NO: 732018 - DNA, 13 bp, C. elegans
ttaaaattggttt

SEQ ID NO: 732019 - DNA, 13 bp, C. elegans
ttaaaattgtcaa

SEQ ID NO: 732020 - DNA, 13 bp, C. elegans
ttaaaatttcaga

SEQ ID NO: 732021 - DNA, 13 bp, C. elegans
ttaaaatttctag

SEQ ID NO: 732022 - DNA, 14 bp, C. elegans
ttaaaatttcttca

SEQ ID NO: 732023 - DNA, 13 bp, C. elegans
ttaaaatttcttg

SEQ ID NO: 732024 - DNA, 13 bp, C. elegans
ttaaaatttggat

SEQ ID NO: 732025 - DNA, 13 bp, C. elegans
ttaaaattttccg

SEQ ID NO: 732026 - DNA, 13 bp, C. elegans
ttaaaattttcga

SEQ ID NO: 732027 - DNA, 13 bp, C. elegans
ttaaaattttctc

SEQ ID NO: 732028 - DNA, 13 bp, C. elegans
ttaaaatttttgg

SEQ ID NO: 732029 - DNA, 13 bp, C. elegans
ttaaacaaagaat

SEQ ID NO: 732030 - DNA, 13 bp, C. elegans
ttaaacaagtttt

SEQ ID NO: 732031 - DNA, 13 bp, C. elegans
ttaaacacaaatt

SEQ ID NO: 732032 - DNA, 13 bp, C. elegans
ttaaacagaaatt

SEQ ID NO: 732033 - DNA, 13 bp, C. elegans
ttaaacatttcaa

SEQ ID NO: 732034 - DNA, 13 bp, C. elegans
ttaaacatttgat

SEQ ID NO: 732035 - DNA, 13 bp, C. elegans
ttaaaccaaactt

SEQ ID NO: 732036 - DNA, 13 bp, C. elegans
ttaaaccaaattt

SEQ ID NO: 732037 - DNA, 13 bp, C. elegans
ttaaaccgagaat

SEQ ID NO: 732038 - DNA, 13 bp, C. elegans
ttaaacctaaatt

SEQ ID NO: 732039 - DNA, 13 bp, C. elegans
ttaaacctaattt

SEQ ID NO: 732040 - DNA, 13 bp, C. elegans
ttaaacgaaattc

SEQ ID NO: 732041 - DNA, 13 bp, C. elegans
ttaaacgacaaaa

SEQ ID NO: 732042 - DNA, 13 bp, C. elegans
ttaaacgtttcaa

SEQ ID NO: 732043 - DNA, 13 bp, C. elegans
ttaaacttgaaat

SEQ ID NO: 732044 - DNA, 13 bp, C. elegans
ttaaacttgttaa

SEQ ID NO: 732045 - DNA, 13 bp, C. elegans
ttaaactttaaac

SEQ ID NO: 732046 - DNA, 13 bp, C. elegans
ttaaactttcaat

SEQ ID NO: 732047 - DNA, 13 bp, C. elegans
ttaaactttccaa

SEQ ID NO: 732048 - DNA, 13 bp, C. elegans
ttaaactttgaat

SEQ ID NO: 732049 - DNA, 13 bp, C. elegans
ttaaacttttatc

SEQ ID NO: 732050 - DNA, 13 bp, C. elegans
ttaaacttttgaa

SEQ ID NO: 732051 - DNA, 13 bp, C. elegans
ttaaagaaatcaa

SEQ ID NO: 732052 - DNA, 13 bp, C. elegans
ttaaagaagtttc

SEQ ID NO: 732053 - DNA, 13 bp, C. elegans
ttaaagaattaca

SEQ ID NO: 732054 - DNA, 13 bp, C. elegans
ttaaagaattgaa

SEQ ID NO: 732055 - DNA, 13 bp, C. elegans
ttaaagatgaaat

SEQ ID NO: 732056 - DNA, 13 bp, C. elegans
ttaaagatttatc

SEQ ID NO: 732057 - DNA, 13 bp, C. elegans
ttaaagctaattt

SEQ ID NO: 732058 - DNA, 13 bp, C. elegans
ttaaagctgaaat

SEQ ID NO: 732059 - DNA, 13 bp, C. elegans
ttaaagcttttaa

SEQ ID NO: 732060 - DNA, 13 bp, C. elegans
ttaaagcttttta

SEQ ID NO: 732061 - DNA, 13 bp, C. elegans
ttaaaggaaaatc

SEQ ID NO: 732062 - DNA, 13 bp, C. elegans
ttaaaggaaaatt

SEQ ID NO: 732063 - DNA, 13 bp, C. elegans
ttaaaggaacata

SEQ ID NO: 732064 - DNA, 13 bp, C. elegans
ttaaaggaggagt

SEQ ID NO: 732065 - DNA, 13 bp, C. elegans
ttaaaggcaaaaa

SEQ ID NO: 732066 - DNA, 13 bp, C. elegans
ttaaaggcgcaca

SEQ ID NO: 732067 - DNA, 13 bp, C. elegans
ttaaaggcgcata

SEQ ID NO: 732068 - DNA, 13 bp, C. elegans
ttaaaggtacatg

SEQ ID NO: 732069 - DNA, 13 bp, C. elegans
ttaaaggtggact

SEQ ID NO: 732070 - DNA, 13 bp, C. elegans
ttaaaggtggagt

SEQ ID NO: 732071 - DNA, 13 bp, C. elegans
ttaaagtcaaaac

SEQ ID NO: 732072 - DNA, 13 bp, C. elegans
ttaaagtcgaaaa

SEQ ID NO: 732073 - DNA, 13 bp, C. elegans
ttaaagtggaaaa

SEQ ID NO: 732074 - DNA, 13 bp, C. elegans
ttaaagttaactt

SEQ ID NO: 732075 - DNA, 13 bp, C. elegans
ttaaagttggagt

SEQ ID NO: 732076 - DNA, 13 bp, C. elegans
ttaaagtttattc

SEQ ID NO: 732077 - DNA, 13 bp, C. elegans
ttaaagtttcaga

SEQ ID NO: 732078 - DNA, 13 bp, C. elegans
ttaaagtttcagt

SEQ ID NO: 732079 - DNA, 13 bp, C. elegans
ttaaagtttcgaa

SEQ ID NO: 732080 - DNA, 13 bp, C. elegans
ttaaagttttaca

SEQ ID NO: 732081 - DNA, 13 bp, C. elegans
ttaaagttttcga

SEQ ID NO: 732082 - DNA, 13 bp, C. elegans
ttaaagttttgca

SEQ ID NO: 732083 - DNA, 13 bp, C. elegans
ttaaagtttttgg

SEQ ID NO: 732084 - DNA, 13 bp, C. elegans
ttaaatactcttt

SEQ ID NO: 732085 - DNA, 13 bp, C. elegans
ttaaatatcgaaa

SEQ ID NO: 732086 - DNA, 13 bp, C. elegans
ttaaatatcttga

SEQ ID NO: 732087 - DNA, 13 bp, C. elegans
ttaaatcaaaatc

SEQ ID NO: 732088 - DNA, 13 bp, C. elegans
ttaaatcaacttt

SEQ ID NO: 732089 - DNA, 13 bp, C. elegans
ttaaatcaatttc

SEQ ID NO: 732090 - DNA, 13 bp, C. elegans
ttaaatcagattt

SEQ ID NO: 732091 - DNA, 13 bp, C. elegans
ttaaatcgattta

SEQ ID NO: 732092 - DNA, 13 bp, C. elegans
ttaaatctgaaat

SEQ ID NO: 732093 - DNA, 13 bp, C. elegans
ttaaatctgaatt

SEQ ID NO: 732094 - DNA, 13 bp, C. elegans
ttaaatcttatca

SEQ ID NO: 732095 - DNA, 13 bp, C. elegans
ttaaatcttcaat

SEQ ID NO: 732096 - DNA, 13 bp, C. elegans
ttaaatgaaaaac

SEQ ID NO: 732097 - DNA, 13 bp, C. elegans
ttaaatgaaagct

SEQ ID NO: 732098 - DNA, 13 bp, C. elegans
ttaaatgaagttt

SEQ ID NO: 732099 - DNA, 13 bp, C. elegans
ttaaatgaatttc

SEQ ID NO: 732100 - DNA, 13 bp, C. elegans
ttaaatgcatttt

SEQ ID NO: 732101 - DNA, 13 bp, C. elegans
ttaaatgccaaaa

SEQ ID NO: 732102 - DNA, 13 bp, C. elegans
ttaaatgcgaaaa

SEQ ID NO: 732103 - DNA, 13 bp, C. elegans
ttaaatggaaaat

SEQ ID NO: 732104 - DNA, 13 bp, C. elegans
ttaaatggaattt

SEQ ID NO: 732105 - DNA, 13 bp, C. elegans
ttaaatgtcagaa

SEQ ID NO: 732106 - DNA, 13 bp, C. elegans
ttaaatgtgaatt

SEQ ID NO: 732107 - DNA, 13 bp, C. elegans
ttaaatgtggagt

SEQ ID NO: 732108 - DNA, 13 bp, C. elegans
ttaaatgtttaag

SEQ ID NO: 732109 - DNA, 13 bp, C. elegans
ttaaatgttttca

SEQ ID NO: 732110 - DNA, 13 bp, C. elegans
ttaaatgtttttc

SEQ ID NO: 732111 - DNA, 13 bp, C. elegans
ttaaattatcgtt

SEQ ID NO: 732112 - DNA, 13 bp, C. elegans
ttaaattattcgt

SEQ ID NO: 732113 - DNA, 13 bp, C. elegans
ttaaattatttcc

SEQ ID NO: 732114 - DNA, 13 bp, C. elegans
ttaaattcaaatc

SEQ ID NO: 732115 - DNA, 13 bp, C. elegans
ttaaattcaacat

SEQ ID NO: 732116 - DNA, 13 bp, C. elegans
ttaaattcaattc

SEQ ID NO: 732117 - DNA, 13 bp, C. elegans
ttaaattcagaaa

SEQ ID NO: 732118 - DNA, 13 bp, C. elegans
ttaaattcagaat

SEQ ID NO: 732119 - DNA, 13 bp, C. elegans
ttaaattcagctg

SEQ ID NO: 732120 - DNA, 13 bp, C. elegans
ttaaattcctcat

SEQ ID NO: 732121 - DNA, 13 bp, C. elegans
ttaaattcgaaaa

SEQ ID NO: 732122 - DNA, 13 bp, C. elegans
ttaaattctgaaa

SEQ ID NO: 732123 - DNA, 13 bp, C. elegans
ttaaattctggca

SEQ ID NO: 732124 - DNA, 13 bp, C. elegans
ttaaattgacaca

SEQ ID NO: 732125 - DNA, 13 bp, C. elegans
ttaaattgtcaaa

SEQ ID NO: 732126 - DNA, 13 bp, C. elegans
ttaaattgttcaa

SEQ ID NO: 732127 - DNA, 13 bp, C. elegans
ttaaattgtttca

SEQ ID NO: 732128 - DNA, 14 bp, C. elegans
ttaaatttcaaact

SEQ ID NO: 732129 - DNA, 13 bp, C. elegans
ttaaatttcattg

SEQ ID NO: 732130 - DNA, 13 bp, C. elegans
ttaaatttccgac

SEQ ID NO: 732131 - DNA, 13 bp, C. elegans
ttaaatttctcag

SEQ ID NO: 732132 - DNA, 13 bp, C. elegans
ttaaatttctgat

SEQ ID NO: 732133 - DNA, 13 bp, C. elegans
ttaaatttgagaa

SEQ ID NO: 732134 - DNA, 13 bp, C. elegans
ttaaatttgcaac

SEQ ID NO: 732135 - DNA, 13 bp, C. elegans
ttaaattttcatg

SEQ ID NO: 732136 - DNA, 13 bp, C. elegans
ttaaattttccac

SEQ ID NO: 732137 - DNA, 13 bp, C. elegans
ttaaattttccgc

SEQ ID NO: 732138 - DNA, 13 bp, C. elegans
ttaaattttgcaa

SEQ ID NO: 732139 - DNA, 13 bp, C. elegans
ttaacaaaaaagc

SEQ ID NO: 732140 - DNA, 13 bp, C. elegans
ttaacaaaatgaa

SEQ ID NO: 732141 - DNA, 13 bp, C. elegans
ttaacaaacaatt

SEQ ID NO: 732142 - DNA, 13 bp, C. elegans
ttaacaaagaaat

SEQ ID NO: 732143 - DNA, 13 bp, C. elegans
ttaacaaatttct

SEQ ID NO: 732144 - DNA, 13 bp, C. elegans
ttaacaaattttg

SEQ ID NO: 732145 - DNA, 13 bp, C. elegans
ttaacaatatttc

SEQ ID NO: 732146 - DNA, 13 bp, C. elegans
ttaacaatgtttt

SEQ ID NO: 732147 - DNA, 13 bp, C. elegans
ttaacaattgttt

SEQ ID NO: 732148 - DNA, 13 bp, C. elegans
ttaacaattttca

SEQ ID NO: 732149 - DNA, 13 bp, C. elegans
ttaacaattttct

SEQ ID NO: 732150 - DNA, 13 bp, C. elegans
ttaacaattttgt

SEQ ID NO: 732151 - DNA, 13 bp, C. elegans
ttaacactttttg

SEQ ID NO: 732152 - DNA, 13 bp, C. elegans
ttaacagaaaata

SEQ ID NO: 732153 - DNA, 13 bp, C. elegans
ttaacagttttca

SEQ ID NO: 732154 - DNA, 13 bp, C. elegans
ttaacagttttgt

SEQ ID NO: 732155 - DNA, 13 bp, C. elegans
ttaacagttttta

SEQ ID NO: 732156 - DNA, 13 bp, C. elegans
ttaacatattttc

SEQ ID NO: 732157 - DNA, 13 bp, C. elegans
ttaacatcatttt

SEQ ID NO: 732158 - DNA, 13 bp, C. elegans
ttaacatgaaaaa

SEQ ID NO: 732159 - DNA, 13 bp, C. elegans
ttaacattgtgtt

SEQ ID NO: 732160 - DNA, 13 bp, C. elegans
ttaacattttcta

SEQ ID NO: 732161 - DNA, 13 bp, C. elegans
ttaacctatcaaa

SEQ ID NO: 732162 - DNA, 13 bp, C. elegans
ttaacggaatttt

SEQ ID NO: 732163 - DNA, 13 bp, C. elegans
ttaacgttttaaa

SEQ ID NO: 732164 - DNA, 13 bp, C. elegans
ttaactaccaaaa

SEQ ID NO: 732165 - DNA, 13 bp, C. elegans
ttaactcaaaatt

SEQ ID NO: 732166 - DNA, 13 bp, C. elegans
ttaactgataaaa

SEQ ID NO: 732167 - DNA, 13 bp, C. elegans
ttaactgattttt

SEQ ID NO: 732168 - DNA, 13 bp, C. elegans
ttaactgtaaaat

SEQ ID NO: 732169 - DNA, 13 bp, C. elegans
ttaactgttttta

SEQ ID NO: 732170 - DNA, 13 bp, C. elegans
ttaactgtttttc

SEQ ID NO: 732171 - DNA, 13 bp, C. elegans
ttaacttattcat

SEQ ID NO: 732172 - DNA, 13 bp, C. elegans
ttaacttcaaata

SEQ ID NO: 732173 - DNA, 13 bp, C. elegans
ttaacttcaaatt

SEQ ID NO: 732174 - DNA, 13 bp, C. elegans
ttaacttcgaact

SEQ ID NO: 732175 - DNA, 13 bp, C. elegans
ttaactttcaaat

SEQ ID NO: 732176 - DNA, 13 bp, C. elegans
ttaactttctaaa

SEQ ID NO: 732177 - DNA, 13 bp, C. elegans
ttaacttttcgaa

SEQ ID NO: 732178 - DNA, 13 bp, C. elegans
ttaacttttgaaa

SEQ ID NO: 732179 - DNA, 13 bp, C. elegans
ttaactttttgaa

SEQ ID NO: 732180 - DNA, 13 bp, C. elegans
ttaagaaaaaagc

SEQ ID NO: 732181 - DNA, 13 bp, C. elegans
ttaagaaaaaatc

SEQ ID NO: 732182 - DNA, 13 bp, C. elegans
ttaagaaaattga

SEQ ID NO: 732183 - DNA, 13 bp, C. elegans
ttaagaaacattt

SEQ ID NO: 732184 - DNA, 13 bp, C. elegans
ttaagaaatttga

SEQ ID NO: 732185 - DNA, 13 bp, C. elegans
ttaagaacatgct

SEQ ID NO: 732186 - DNA, 13 bp, C. elegans
ttaagaacttttt

SEQ ID NO: 732187 - DNA, 13 bp, C. elegans
ttaagaattttga

SEQ ID NO: 732188 - DNA, 13 bp, C. elegans
ttaagacattttt

SEQ ID NO: 732189 - DNA, 13 bp, C. elegans
ttaagacgatttt

SEQ ID NO: 732190 - DNA, 13 bp, C. elegans
ttaagatcaattt

SEQ ID NO: 732191 - DNA, 13 bp, C. elegans
ttaagatttttag

SEQ ID NO: 732192 - DNA, 13 bp, C. elegans
ttaagcaaaagtt

SEQ ID NO: 732193 - DNA, 13 bp, C. elegans
ttaagcaaacttc

SEQ ID NO: 732194 - DNA, 13 bp, C. elegans
ttaagcaaatttt

SEQ ID NO: 732195 - DNA, 13 bp, C. elegans
ttaagcacggcaa

SEQ ID NO: 732196 - DNA, 13 bp, C. elegans
ttaagccaaaaaa

SEQ ID NO: 732197 - DNA, 13 bp, C. elegans
ttaagcctatttt

SEQ ID NO: 732198 - DNA, 13 bp, C. elegans
ttaagcgaaaaat

SEQ ID NO: 732199 - DNA, 13 bp, C. elegans
ttaagctgagcaa

SEQ ID NO: 732200 - DNA, 13 bp, C. elegans
ttaagctttttaa

SEQ ID NO: 732201 - DNA, 13 bp, C. elegans
ttaaggttttaaa

SEQ ID NO: 732202 - DNA, 13 bp, C. elegans
ttaagtacatttt

SEQ ID NO: 732203 - DNA, 13 bp, C. elegans
ttaagtgaaaatg

SEQ ID NO: 732204 - DNA, 13 bp, C. elegans
ttaagttattttc

SEQ ID NO: 732205 - DNA, 13 bp, C. elegans
ttaagtttcttaa

SEQ ID NO: 732206 - DNA, 13 bp, C. elegans
ttaagtttgaaat

SEQ ID NO: 732207 - DNA, 13 bp, C. elegans
ttaagtttttcaa

SEQ ID NO: 732208 - DNA, 13 bp, C. elegans
ttaataacgtttt

SEQ ID NO: 732209 - DNA, 13 bp, C. elegans
ttaataattccaa

SEQ ID NO: 732210 - DNA, 13 bp, C. elegans
ttaatacaatttg

SEQ ID NO: 732211 - DNA, 13 bp, C. elegans
ttaatataacctc

SEQ ID NO: 732212 - DNA, 13 bp, C. elegans
ttaatatctcggc

SEQ ID NO: 732213 - DNA, 13 bp, C. elegans
ttaatatgtttca

SEQ ID NO: 732214 - DNA, 13 bp, C. elegans
ttaatattcaaac

SEQ ID NO: 732215 - DNA, 13 bp, C. elegans
ttaatattcacaa

SEQ ID NO: 732216 - DNA, 13 bp, C. elegans
ttaatatttcgaa

SEQ ID NO: 732217 - DNA, 13 bp, C. elegans
ttaatattttcag

SEQ ID NO: 732218 - DNA, 13 bp, C. elegans
ttaatcaaaattg

SEQ ID NO: 732219 - DNA, 13 bp, C. elegans
ttaatcaaacatt

SEQ ID NO: 732220 - DNA, 13 bp, C. elegans
ttaatcaacgaaa

SEQ ID NO: 732221 - DNA, 13 bp, C. elegans
ttaatcaactttt

SEQ ID NO: 732222 - DNA, 13 bp, C. elegans
ttaatcaagttta

SEQ ID NO: 732223 - DNA, 13 bp, C. elegans
ttaatcaatttct

SEQ ID NO: 732224 - DNA, 13 bp, C. elegans
ttaatcaatttgt

SEQ ID NO: 732225 - DNA, 13 bp, C. elegans
ttaatcagttttc

SEQ ID NO: 732226 - DNA, 13 bp, C. elegans
ttaatcagttttg

SEQ ID NO: 732227 - DNA, 13 bp, C. elegans
ttaatcatgatat

SEQ ID NO: 732228 - DNA, 13 bp, C. elegans
ttaatcattttcc

SEQ ID NO: 732229 - DNA, 13 bp, C. elegans
ttaatccaataaa

SEQ ID NO: 732230 - DNA, 13 bp, C. elegans
ttaatcgaaaaag

SEQ ID NO: 732231 - DNA, 13 bp, C. elegans
ttaatcgaaaaat

SEQ ID NO: 732232 - DNA, 13 bp, C. elegans
ttaatcgacgaaa

SEQ ID NO: 732233 - DNA, 13 bp, C. elegans
ttaatcgagtttt

SEQ ID NO: 732234 - DNA, 13 bp, C. elegans
ttaatcgattttt

SEQ ID NO: 732235 - DNA, 13 bp, C. elegans
ttaatcggaattt

SEQ ID NO: 732236 - DNA, 13 bp, C. elegans
ttaatctcattta

SEQ ID NO: 732237 - DNA, 13 bp, C. elegans
ttaatctccaaaa

SEQ ID NO: 732238 - DNA, 13 bp, C. elegans
ttaatctgaaatt

SEQ ID NO: 732239 - DNA, 13 bp, C. elegans
ttaatctgtaaaa

SEQ ID NO: 732240 - DNA, 13 bp, C. elegans
ttaatcttcaaaa

SEQ ID NO: 732241 - DNA, 13 bp, C. elegans
ttaatctttcaaa

SEQ ID NO: 732242 - DNA, 13 bp, C. elegans
ttaatcttttgaa

SEQ ID NO: 732243 - DNA, 13 bp, C. elegans
ttaatgaagaaat

SEQ ID NO: 732244 - DNA, 13 bp, C. elegans
ttaatgaattttc

SEQ ID NO: 732245 - DNA, 13 bp, C. elegans
ttaatgactaaaa

SEQ ID NO: 732246 - DNA, 13 bp, C. elegans
ttaatgagaaatt

SEQ ID NO: 732247 - DNA, 13 bp, C. elegans
ttaatgagatttt

SEQ ID NO: 732248 - DNA, 13 bp, C. elegans
ttaatgatttcaa

SEQ ID NO: 732249 - DNA, 13 bp, C. elegans
ttaatgcgaaaat

SEQ ID NO: 732250 - DNA, 13 bp, C. elegans
ttaatggaaaaca

SEQ ID NO: 732251 - DNA, 13 bp, C. elegans
ttaatggaaataa

SEQ ID NO: 732252 - DNA, 13 bp, C. elegans
ttaatggaagatg

SEQ ID NO: 732253 - DNA, 13 bp, C. elegans
ttaatggaattgt

SEQ ID NO: 732254 - DNA, 13 bp, C. elegans
ttaatggaatttc

SEQ ID NO: 732255 - DNA, 13 bp, C. elegans
ttaatggtttttc

SEQ ID NO: 732256 - DNA, 13 bp, C. elegans
ttaatgtcaaaat

SEQ ID NO: 732257 - DNA, 13 bp, C. elegans
ttaatgtgaaata

SEQ ID NO: 732258 - DNA, 13 bp, C. elegans
ttaatgttttcca

SEQ ID NO: 732259 - DNA, 13 bp, C. elegans
ttaatgttttcgg

SEQ ID NO: 732260 - DNA, 13 bp, C. elegans
ttaattaaaacac

SEQ ID NO: 732261 - DNA, 13 bp, C. elegans
ttaattatcgatt

SEQ ID NO: 732262 - DNA, 13 bp, C. elegans
ttaattcaaattg

SEQ ID NO: 732263 - DNA, 13 bp, C. elegans
ttaattcagaaaa

SEQ ID NO: 732264 - DNA, 13 bp, C. elegans
ttaattcagtttt

SEQ ID NO: 732265 - DNA, 13 bp, C. elegans
ttaattcatcatt

SEQ ID NO: 732266 - DNA, 13 bp, C. elegans
ttaattcattgaa

SEQ ID NO: 732267 - DNA, 13 bp, C. elegans
ttaattccaaaaa

SEQ ID NO: 732268 - DNA, 13 bp, C. elegans
ttaattccggcaa

SEQ ID NO: 732269 - DNA, 13 bp, C. elegans
ttaattccgtcaa

SEQ ID NO: 732270 - DNA, 13 bp, C. elegans
ttaattcgatttt

SEQ ID NO: 732271 - DNA, 13 bp, C. elegans
ttaattctacaaa

SEQ ID NO: 732272 - DNA, 13 bp, C. elegans
ttaattctagaaa

SEQ ID NO: 732273 - DNA, 13 bp, C. elegans
ttaattctctaca

SEQ ID NO: 732274 - DNA, 13 bp, C. elegans
ttaattctttcaa

SEQ ID NO: 732275 - DNA, 13 bp, C. elegans
ttaattgaaaact

SEQ ID NO: 732276 - DNA, 13 bp, C. elegans
ttaattgaaaatg

SEQ ID NO: 732277 - DNA, 13 bp, C. elegans
ttaattgaaactg

SEQ ID NO: 732278 - DNA, 13 bp, C. elegans
ttaattgaaagtt

SEQ ID NO: 732279 - DNA, 13 bp, C. elegans
ttaattgatcagt

SEQ ID NO: 732280 - DNA, 13 bp, C. elegans
ttaattgcatttt

SEQ ID NO: 732281 - DNA, 13 bp, C. elegans
ttaattgccaaaa

SEQ ID NO: 732282 - DNA, 13 bp, C. elegans
ttaattgctaatt

SEQ ID NO: 732283 - DNA, 13 bp, C. elegans
ttaattggaaata

SEQ ID NO: 732284 - DNA, 13 bp, C. elegans
ttaattggaagtt

SEQ ID NO: 732285 - DNA, 13 bp, C. elegans
ttaattgtaacat

SEQ ID NO: 732286 - DNA, 13 bp, C. elegans
ttaattgtgaaaa

SEQ ID NO: 732287 - DNA, 13 bp, C. elegans
ttaattgtttcca

SEQ ID NO: 732288 - DNA, 13 bp, C. elegans
ttaatttactgaa

SEQ ID NO: 732289 - DNA, 13 bp, C. elegans
ttaatttatttcg

SEQ ID NO: 732290 - DNA, 13 bp, C. elegans
ttaatttcaactt

SEQ ID NO: 732291 - DNA, 13 bp, C. elegans
ttaatttcaagtt

SEQ ID NO: 732292 - DNA, 13 bp, C. elegans
ttaatttcagaaa

SEQ ID NO: 732293 - DNA, 13 bp, C. elegans
ttaatttcagatt

SEQ ID NO: 732294 - DNA, 13 bp, C. elegans
ttaatttcagcaa

SEQ ID NO: 732295 - DNA, 13 bp, C. elegans
ttaatttcagttt

SEQ ID NO: 732296 - DNA, 13 bp, C. elegans
ttaatttcctcat

SEQ ID NO: 732297 - DNA, 13 bp, C. elegans
ttaatttcgaaaa

SEQ ID NO: 732298 - DNA, 13 bp, C. elegans
ttaatttcgaatt

SEQ ID NO: 732299 - DNA, 13 bp, C. elegans
ttaatttctgatt

SEQ ID NO: 732300 - DNA, 13 bp, C. elegans
ttaatttcttgaa

SEQ ID NO: 732301 - DNA, 13 bp, C. elegans
ttaatttgctgaa

SEQ ID NO: 732302 - DNA, 13 bp, C. elegans
ttaatttggaaat

SEQ ID NO: 732303 - DNA, 13 bp, C. elegans
ttaatttgttgaa

SEQ ID NO: 732304 - DNA, 13 bp, C. elegans
ttaattttacagt

SEQ ID NO: 732305 - DNA, 13 bp, C. elegans
ttaattttcacgt

SEQ ID NO: 732306 - DNA, 13 bp, C. elegans
ttaattttcagtt

SEQ ID NO: 732307 - DNA, 13 bp, C. elegans
ttaattttccaaa

SEQ ID NO: 732308 - DNA, 13 bp, C. elegans
ttaattttccgaa

SEQ ID NO: 732309 - DNA, 13 bp, C. elegans
ttaattttccgcc

SEQ ID NO: 732310 - DNA, 13 bp, C. elegans
ttaattttcgaaa

SEQ ID NO: 732311 - DNA, 13 bp, C. elegans
ttaattttctcaa

SEQ ID NO: 732312 - DNA, 13 bp, C. elegans
ttaattttctctg

SEQ ID NO: 732313 - DNA, 13 bp, C. elegans
ttaattttctgat

SEQ ID NO: 732314 - DNA, 13 bp, C. elegans
ttaattttcttga

SEQ ID NO: 732315 - DNA, 13 bp, C. elegans
ttaattttgaaca

SEQ ID NO: 732316 - DNA, 13 bp, C. elegans
ttaattttgatca

SEQ ID NO: 732317 - DNA, 13 bp, C. elegans
ttaattttggaag

SEQ ID NO: 732318 - DNA, 13 bp, C. elegans
ttaattttgtgaa

SEQ ID NO: 732319 - DNA, 13 bp, C. elegans
ttaatttttacgt

SEQ ID NO: 732320 - DNA, 13 bp, C. elegans
ttaatttttagcc

SEQ ID NO: 732321 - DNA, 13 bp, C. elegans
ttaatttttccag

SEQ ID NO: 732322 - DNA, 13 bp, C. elegans
ttaatttttgcaa

SEQ ID NO: 732323 - DNA, 13 bp, C. elegans
ttaatttttgcag

SEQ ID NO: 732324 - DNA, 13 bp, C. elegans
ttacaaaaaattg

SEQ ID NO: 732325 - DNA, 13 bp, C. elegans
ttacaaaaatctt

SEQ ID NO: 732326 - DNA, 13 bp, C. elegans
ttacaaaaattgt

SEQ ID NO: 732327 - DNA, 13 bp, C. elegans
ttacaaaacaatt

SEQ ID NO: 732328 - DNA, 13 bp, C. elegans
ttacaaaagtttt

SEQ ID NO: 732329 - DNA, 13 bp, C. elegans
ttacaaaatcata

SEQ ID NO: 732330 - DNA, 13 bp, C. elegans
ttacaaaattcga

SEQ ID NO: 732331 - DNA, 13 bp, C. elegans
ttacaaacttttg

SEQ ID NO: 732332 - DNA, 13 bp, C. elegans
ttacaaagatttt

SEQ ID NO: 732333 - DNA, 13 bp, C. elegans
ttacaaagtttta

SEQ ID NO: 732334 - DNA, 13 bp, C. elegans
ttacaaataaact

SEQ ID NO: 732335 - DNA, 13 bp, C. elegans
ttacaaatattca

SEQ ID NO: 732336 - DNA, 13 bp, C. elegans
ttacaaatgttat

SEQ ID NO: 732337 - DNA, 13 bp, C. elegans
ttacaaatgttca

SEQ ID NO: 732338 - DNA, 13 bp, C. elegans
ttacaaattcaaa

SEQ ID NO: 732339 - DNA, 13 bp, C. elegans
ttacaaattgaaa

SEQ ID NO: 732340 - DNA, 13 bp, C. elegans
ttacaaatttcca

SEQ ID NO: 732341 - DNA, 13 bp, C. elegans
ttacaacaaaatt

SEQ ID NO: 732342 - DNA, 13 bp, C. elegans
ttacaacagaaaa

SEQ ID NO: 732343 - DNA, 13 bp, C. elegans
ttacaacttaaaa

SEQ ID NO: 732344 - DNA, 13 bp, C. elegans
ttacaagaaaaac

SEQ ID NO: 732345 - DNA, 13 bp, C. elegans
ttacaagtttttt

SEQ ID NO: 732346 - DNA, 13 bp, C. elegans
ttacaataaactt

SEQ ID NO: 732347 - DNA, 13 bp, C. elegans
ttacaataaagtt

SEQ ID NO: 732348 - DNA, 13 bp, C. elegans
ttacaatcaaatt

SEQ ID NO: 732349 - DNA, 13 bp, C. elegans
ttacaatgtattc

SEQ ID NO: 732350 - DNA, 13 bp, C. elegans
ttacaatgtttta

SEQ ID NO: 732351 - DNA, 13 bp, C. elegans
ttacaattacaaa

SEQ ID NO: 732352 - DNA, 13 bp, C. elegans
ttacaattgaatt

SEQ ID NO: 732353 - DNA, 13 bp, C. elegans
ttacaatttcttg

SEQ ID NO: 732354 - DNA, 13 bp, C. elegans
ttacaattttcag

SEQ ID NO: 732355 - DNA, 13 bp, C. elegans
ttacacaaaaatt

SEQ ID NO: 732356 - DNA, 13 bp, C. elegans
ttacacaacatat

SEQ ID NO: 732357 - DNA, 13 bp, C. elegans
ttacactaaaaat

SEQ ID NO: 732358 - DNA, 13 bp, C. elegans
ttacactattttc

SEQ ID NO: 732359 - DNA, 13 bp, C. elegans
ttacagaaaaatc

SEQ ID NO: 732360 - DNA, 13 bp, C. elegans
ttacagaaaatat

SEQ ID NO: 732361 - DNA, 13 bp, C. elegans
ttacagaacattt

SEQ ID NO: 732362 - DNA, 13 bp, C. elegans
ttacagtaacccg

SEQ ID NO: 732363 - DNA, 13 bp, C. elegans
ttacagtaaccct

SEQ ID NO: 732364 - DNA, 13 bp, C. elegans
ttacagtaacttg

SEQ ID NO: 732365 - DNA, 13 bp, C. elegans
ttacagtaatacc

SEQ ID NO: 732366 - DNA, 13 bp, C. elegans
ttacagtactctt

SEQ ID NO: 732367 - DNA, 13 bp, C. elegans
ttacagtagtttt

SEQ ID NO: 732368 - DNA, 13 bp, C. elegans
ttacagtcaattt

SEQ ID NO: 732369 - DNA, 13 bp, C. elegans
ttacagtcattat

SEQ ID NO: 732370 - DNA, 13 bp, C. elegans
ttacagtgaaaaa

SEQ ID NO: 732371 - DNA, 13 bp, C. elegans
ttacagtgaaaat

SEQ ID NO: 732372 - DNA, 13 bp, C. elegans
ttacagtgaattt

SEQ ID NO: 732373 - DNA, 13 bp, C. elegans
ttacagtgctatt

SEQ ID NO: 732374 - DNA, 13 bp, C. elegans
ttacagttaaaaa

SEQ ID NO: 732375 - DNA, 13 bp, C. elegans
ttacagttatatt

SEQ ID NO: 732376 - DNA, 13 bp, C. elegans
ttacagttgtttt

SEQ ID NO: 732377 - DNA, 13 bp, C. elegans
ttacagtttaaaa

SEQ ID NO: 732378 - DNA, 13 bp, C. elegans
ttacagtttcaag

SEQ ID NO: 732379 - DNA, 13 bp, C. elegans
ttacagtttttgt

SEQ ID NO: 732380 - DNA, 13 bp, C. elegans
ttacatagatttt

SEQ ID NO: 732381 - DNA, 13 bp, C. elegans
ttacatcaatttt

SEQ ID NO: 732382 - DNA, 13 bp, C. elegans
ttacatgaaattt

SEQ ID NO: 732383 - DNA, 13 bp, C. elegans
ttacatgttttat

SEQ ID NO: 732384 - DNA, 13 bp, C. elegans
ttacattagaaaa

SEQ ID NO: 732385 - DNA, 13 bp, C. elegans
ttacattcaaatt

SEQ ID NO: 732386 - DNA, 13 bp, C. elegans
ttacattgaaaat

SEQ ID NO: 732387 - DNA, 13 bp, C. elegans
ttacattgaccac

SEQ ID NO: 732388 - DNA, 13 bp, C. elegans
ttacattggaaaa

SEQ ID NO: 732389 - DNA, 13 bp, C. elegans
ttacatttgaata

SEQ ID NO: 732390 - DNA, 13 bp, C. elegans
ttacattttcaaa

SEQ ID NO: 732391 - DNA, 13 bp, C. elegans
ttacatttttcag

SEQ ID NO: 732392 - DNA, 13 bp, C. elegans
ttaccaaaaaatg

SEQ ID NO: 732393 - DNA, 13 bp, C. elegans
ttaccaaaaactt

SEQ ID NO: 732394 - DNA, 13 bp, C. elegans
ttaccaaaaattc

SEQ ID NO: 732395 - DNA, 13 bp, C. elegans
ttaccaaaataag

SEQ ID NO: 732396 - DNA, 13 bp, C. elegans
ttaccaaaatcaa

SEQ ID NO: 732397 - DNA, 13 bp, C. elegans
ttaccaaaattct

SEQ ID NO: 732398 - DNA, 13 bp, C. elegans
ttaccaaacattt

SEQ ID NO: 732399 - DNA, 13 bp, C. elegans
ttaccaaattgtt

SEQ ID NO: 732400 - DNA, 13 bp, C. elegans
ttaccaaatttct

SEQ ID NO: 732401 - DNA, 13 bp, C. elegans
ttaccaacttttg

SEQ ID NO: 732402 - DNA, 13 bp, C. elegans
ttaccaagatttt

SEQ ID NO: 732403 - DNA, 13 bp, C. elegans
ttaccaattttct

SEQ ID NO: 732404 - DNA, 13 bp, C. elegans
ttaccaatttttc

SEQ ID NO: 732405 - DNA, 13 bp, C. elegans
ttaccactttttg

SEQ ID NO: 732406 - DNA, 13 bp, C. elegans
ttaccataaaatt

SEQ ID NO: 732407 - DNA, 13 bp, C. elegans
ttaccattttttg

SEQ ID NO: 732408 - DNA, 13 bp, C. elegans
ttacccaaattgt

SEQ ID NO: 732409 - DNA, 13 bp, C. elegans
ttacccattttca

SEQ ID NO: 732410 - DNA, 13 bp, C. elegans
ttacccgaaaatt

SEQ ID NO: 732411 - DNA, 13 bp, C. elegans
ttaccctggaaac

SEQ ID NO: 732412 - DNA, 13 bp, C. elegans
ttaccgattttcc

SEQ ID NO: 732413 - DNA, 13 bp, C. elegans
ttaccgctacttg

SEQ ID NO: 732414 - DNA, 13 bp, C. elegans
ttaccggatttgt

SEQ ID NO: 732415 - DNA, 13 bp, C. elegans
ttaccgtactctt

SEQ ID NO: 732416 - DNA, 13 bp, C. elegans
ttaccgtatttcc

SEQ ID NO: 732417 - DNA, 13 bp, C. elegans
ttaccgtatttct

SEQ ID NO: 732418 - DNA, 13 bp, C. elegans
ttacctaattttc

SEQ ID NO: 732419 - DNA, 13 bp, C. elegans
ttacctgaaaatt

SEQ ID NO: 732420 - DNA, 13 bp, C. elegans
ttacctgcctgcc

SEQ ID NO: 732421 - DNA, 13 bp, C. elegans
ttacgagcattat

SEQ ID NO: 732422 - DNA, 13 bp, C. elegans
ttacgagtttttt

SEQ ID NO: 732423 - DNA, 13 bp, C. elegans
ttacgatatgata

SEQ ID NO: 732424 - DNA, 13 bp, C. elegans
ttacgcaaaaatt

SEQ ID NO: 732425 - DNA, 13 bp, C. elegans
ttacgcgcaaaaa

SEQ ID NO: 732426 - DNA, 13 bp, C. elegans
ttacgctgaaaat

SEQ ID NO: 732427 - DNA, 13 bp, C. elegans
ttacggaaaatat

SEQ ID NO: 732428 - DNA, 13 bp, C. elegans
ttacggaattttg

SEQ ID NO: 732429 - DNA, 13 bp, C. elegans
ttacggtttttat

SEQ ID NO: 732430 - DNA, 13 bp, C. elegans
ttacgtgtttttc

SEQ ID NO: 732431 - DNA, 19 bp, C. elegans
ttacgttccgtccacaaca

SEQ ID NO: 732432 - DNA, 13 bp, C. elegans
ttacgtttcaatt

SEQ ID NO: 732433 - DNA, 13 bp, C. elegans
ttactaaaattga

SEQ ID NO: 732434 - DNA, 13 bp, C. elegans
ttactacatatta

SEQ ID NO: 732435 - DNA, 14 bp, C. elegans
ttactacggaatct

SEQ ID NO: 732436 - DNA, 13 bp, C. elegans
ttactactgtagc

SEQ ID NO: 732437 - DNA, 13 bp, C. elegans
ttactatgatatt

SEQ ID NO: 732438 - DNA, 13 bp, C. elegans
ttactattgaaaa

SEQ ID NO: 732439 - DNA, 13 bp, C. elegans
ttactatttgaaa

SEQ ID NO: 732440 - DNA, 13 bp, C. elegans
ttactcaaatatt

SEQ ID NO: 732441 - DNA, 13 bp, C. elegans
ttactcactatca

SEQ ID NO: 732442 - DNA, 13 bp, C. elegans
ttactcattttca

SEQ ID NO: 732443 - DNA, 13 bp, C. elegans
ttactccaaaaat

SEQ ID NO: 732444 - DNA, 13 bp, C. elegans
ttactcgttgtta

SEQ ID NO: 732445 - DNA, 13 bp, C. elegans
ttactgaaaaaat

SEQ ID NO: 732446 - DNA, 13 bp, C. elegans
ttactgaaaacaa

SEQ ID NO: 732447 - DNA, 13 bp, C. elegans
ttactgaaaatta

SEQ ID NO: 732448 - DNA, 13 bp, C. elegans
ttactgaaattct

SEQ ID NO: 732449 - DNA, 13 bp, C. elegans
ttactgaaattga

SEQ ID NO: 732450 - DNA, 13 bp, C. elegans
ttactgatttgcc

SEQ ID NO: 732451 - DNA, 13 bp, C. elegans
ttactgatttttc

SEQ ID NO: 732452 - DNA, 13 bp, C. elegans
ttactgcaatttt

SEQ ID NO: 732453 - DNA, 13 bp, C. elegans
ttactggaaaaaa

SEQ ID NO: 732454 - DNA, 13 bp, C. elegans
ttactggtttttg

SEQ ID NO: 732455 - DNA, 13 bp, C. elegans
ttactgtaaattt

SEQ ID NO: 732456 - DNA, 13 bp, C. elegans
ttactgtaataat

SEQ ID NO: 732457 - DNA, 13 bp, C. elegans
ttactgtaattat

SEQ ID NO: 732458 - DNA, 13 bp, C. elegans
ttactgtaattta

SEQ ID NO: 732459 - DNA, 13 bp, C. elegans
ttactgtaatttt

SEQ ID NO: 732460 - DNA, 13 bp, C. elegans
ttactgtactttt

SEQ ID NO: 732461 - DNA, 13 bp, C. elegans
ttactgtagaaaa

SEQ ID NO: 732462 - DNA, 13 bp, C. elegans
ttactgtagatca

SEQ ID NO: 732463 - DNA, 13 bp, C. elegans
ttactgtagatga

SEQ ID NO: 732464 - DNA, 13 bp, C. elegans
ttactgtaggaaa

SEQ ID NO: 732465 - DNA, 13 bp, C. elegans
ttactgtagtcgg

SEQ ID NO: 732466 - DNA, 13 bp, C. elegans
ttactgtagttac

SEQ ID NO: 732467 - DNA, 13 bp, C. elegans
ttactgtagtttg

SEQ ID NO: 732468 - DNA, 13 bp, C. elegans
ttactgtagtttt

SEQ ID NO: 732469 - DNA, 13 bp, C. elegans
ttactgtattttc

SEQ ID NO: 732470 - DNA, 13 bp, C. elegans
ttactgtcaaaaa

SEQ ID NO: 732471 - DNA, 13 bp, C. elegans
ttactgtttcaga

SEQ ID NO: 732472 - DNA, 13 bp, C. elegans
ttactgtttcatg

SEQ ID NO: 732473 - DNA, 13 bp, C. elegans
ttactgtttcatt

SEQ ID NO: 732474 - DNA, 13 bp, C. elegans
ttacttatcaaaa

SEQ ID NO: 732475 - DNA, 13 bp, C. elegans
ttacttctcaaaa

SEQ ID NO: 732476 - DNA, 13 bp, C. elegans
ttacttgaaaact

SEQ ID NO: 732477 - DNA, 13 bp, C. elegans
ttactttacaaaa

SEQ ID NO: 732478 - DNA, 13 bp, C. elegans
ttactttccaatt

SEQ ID NO: 732479 - DNA, 13 bp, C. elegans
ttactttgaaatt

SEQ ID NO: 732480 - DNA, 13 bp, C. elegans
ttacttttatgat

SEQ ID NO: 732481 - DNA, 13 bp, C. elegans
ttacttttctgaa

SEQ ID NO: 732482 - DNA, 13 bp, C. elegans
ttacttttgaaat

SEQ ID NO: 732483 - DNA, 13 bp, C. elegans
ttactttttaaca

SEQ ID NO: 732484 - DNA, 13 bp, C. elegans
ttactttttcaaa

SEQ ID NO: 732485 - DNA, 13 bp, C. elegans
ttacttttttgaa

SEQ ID NO: 732486 - DNA, 13 bp, C. elegans
ttacttttttgca

SEQ ID NO: 732487 - DNA, 13 bp, C. elegans
ttagaaaaaatgt

SEQ ID NO: 732488 - DNA, 13 bp, C. elegans
ttagaaaaacaac

SEQ ID NO: 732489 - DNA, 13 bp, C. elegans
ttagaaaaatcaa

SEQ ID NO: 732490 - DNA, 13 bp, C. elegans
ttagaaaaatgta

SEQ ID NO: 732491 - DNA, 13 bp, C. elegans
ttagaaaacagtt

SEQ ID NO: 732492 - DNA, 13 bp, C. elegans
ttagaaaacattt

SEQ ID NO: 732493 - DNA, 13 bp, C. elegans
ttagaaaagttaa

SEQ ID NO: 732494 - DNA, 13 bp, C. elegans
ttagaaaatatca

SEQ ID NO: 732495 - DNA, 13 bp, C. elegans
ttagaaacttcaa

SEQ ID NO: 732496 - DNA, 13 bp, C. elegans
ttagaaatcagaa

SEQ ID NO: 732497 - DNA, 13 bp, C. elegans
ttagaaatcgaaa

SEQ ID NO: 732498 - DNA, 13 bp, C. elegans
ttagaaattactt

SEQ ID NO: 732499 - DNA, 13 bp, C. elegans
ttagaaattttga

SEQ ID NO: 732500 - DNA, 13 bp, C. elegans
ttagaacaatatt

SEQ ID NO: 732501 - DNA, 13 bp, C. elegans
ttagaaccttctg

SEQ ID NO: 732502 - DNA, 13 bp, C. elegans
ttagaactcaaaa

SEQ ID NO: 732503 - DNA, 13 bp, C. elegans
ttagaagagtttc

SEQ ID NO: 732504 - DNA, 13 bp, C. elegans
ttagaagatattt

SEQ ID NO: 732505 - DNA, 13 bp, C. elegans
ttagaatcaaaat

SEQ ID NO: 732506 - DNA, 13 bp, C. elegans
ttagaattacaaa

SEQ ID NO: 732507 - DNA, 13 bp, C. elegans
ttagaattgaata

SEQ ID NO: 732508 - DNA, 13 bp, C. elegans
ttagaattttgat

SEQ ID NO: 732509 - DNA, 13 bp, C. elegans
ttagacaacaaaa

SEQ ID NO: 732510 - DNA, 13 bp, C. elegans
ttagacattttta

SEQ ID NO: 732511 - DNA, 13 bp, C. elegans
ttagaccactttt

SEQ ID NO: 732512 - DNA, 13 bp, C. elegans
ttagacttgaaat

SEQ ID NO: 732513 - DNA, 13 bp, C. elegans
ttagagaagtttt

SEQ ID NO: 732514 - DNA, 13 bp, C. elegans
ttagagaattttc

SEQ ID NO: 732515 - DNA, 13 bp, C. elegans
ttagagatagaaa

SEQ ID NO: 732516 - DNA, 13 bp, C. elegans
ttagagatatcaa

SEQ ID NO: 732517 - DNA, 13 bp, C. elegans
ttagagatatttt

SEQ ID NO: 732518 - DNA, 13 bp, C. elegans
ttagagattaaaa

SEQ ID NO: 732519 - DNA, 13 bp, C. elegans
ttagagcaaaaaa

SEQ ID NO: 732520 - DNA, 13 bp, C. elegans
ttagagttaaaat

SEQ ID NO: 732521 - DNA, 13 bp, C. elegans
ttagagtttttaa

SEQ ID NO: 732522 - DNA, 13 bp, C. elegans
ttagagtttttca

SEQ ID NO: 732523 - DNA, 13 bp, C. elegans
ttagagtttttga

SEQ ID NO: 732524 - DNA, 13 bp, C. elegans
ttagatattttca

SEQ ID NO: 732525 - DNA, 13 bp, C. elegans
ttagatgcaaaaa

SEQ ID NO: 732526 - DNA, 13 bp, C. elegans
ttagatttatttc

SEQ ID NO: 732527 - DNA, 13 bp, C. elegans
ttagatttcaatt

SEQ ID NO: 732528 - DNA, 13 bp, C. elegans
ttagatttgaaaa

SEQ ID NO: 732529 - DNA, 13 bp, C. elegans
ttagattttccat

SEQ ID NO: 732530 - DNA, 13 bp, C. elegans
ttagcaaattcca

SEQ ID NO: 732531 - DNA, 13 bp, C. elegans
ttagcattatttt

SEQ ID NO: 732532 - DNA, 13 bp, C. elegans
ttagcatttttcc

SEQ ID NO: 732533 - DNA, 13 bp, C. elegans
ttagccaaaaaac

SEQ ID NO: 732534 - DNA, 13 bp, C. elegans
ttagccaattttc

SEQ ID NO: 732535 - DNA, 13 bp, C. elegans
ttagccatttttg

SEQ ID NO: 732536 - DNA, 13 bp, C. elegans
ttagccgaaaaaa

SEQ ID NO: 732537 - DNA, 13 bp, C. elegans
ttagcctaatttt

SEQ ID NO: 732538 - DNA, 13 bp, C. elegans
ttagccttaaaaa

SEQ ID NO: 732539 - DNA, 13 bp, C. elegans
ttagcgaaaaaat

SEQ ID NO: 732540 - DNA, 13 bp, C. elegans
ttagctgaaaact

SEQ ID NO: 732541 - DNA, 13 bp, C. elegans
ttagctttaattt

SEQ ID NO: 732542 - DNA, 13 bp, C. elegans
ttagcttttaagc

SEQ ID NO: 732543 - DNA, 13 bp, C. elegans
ttaggaaaacttg

SEQ ID NO: 732544 - DNA, 13 bp, C. elegans
ttaggaaaagttt

SEQ ID NO: 732545 - DNA, 13 bp, C. elegans
ttaggaaattttt

SEQ ID NO: 732546 - DNA, 13 bp, C. elegans
ttaggatttttca

SEQ ID NO: 732547 - DNA, 13 bp, C. elegans
ttaggcaaatttt

SEQ ID NO: 732548 - DNA, 13 bp, C. elegans
ttaggccgttttg

SEQ ID NO: 732549 - DNA, 13 bp, C. elegans
ttaggcgattttt

SEQ ID NO: 732550 - DNA, 13 bp, C. elegans
ttaggctcaggct

SEQ ID NO: 732551 - DNA, 13 bp, C. elegans
ttaggcttaagcg

SEQ ID NO: 732552 - DNA, 13 bp, C. elegans
ttaggcttaggct

SEQ ID NO: 732553 - DNA, 13 bp, C. elegans
ttaggcttatgct

SEQ ID NO: 732554 - DNA, 13 bp, C. elegans
ttaggcttattct

SEQ ID NO: 732555 - DNA, 13 bp, C. elegans
ttagggaaaaaat

SEQ ID NO: 732556 - DNA, 13 bp, C. elegans
ttagggaaaaagt

SEQ ID NO: 732557 - DNA, 13 bp, C. elegans
ttaggtttaggtt

SEQ ID NO: 732558 - DNA, 13 bp, C. elegans
ttaggtttttcaa

SEQ ID NO: 732559 - DNA, 13 bp, C. elegans
ttagtactttttg

SEQ ID NO: 732560 - DNA, 13 bp, C. elegans
ttagtattatggg

SEQ ID NO: 732561 - DNA, 13 bp, C. elegans
ttagtattgcaac

SEQ ID NO: 732562 - DNA, 13 bp, C. elegans
ttagtattgcccc

SEQ ID NO: 732563 - DNA, 13 bp, C. elegans
ttagtatttgaaa

SEQ ID NO: 732564 - DNA, 13 bp, C. elegans
ttagtattttctg

SEQ ID NO: 732565 - DNA, 13 bp, C. elegans
ttagtcatttttc

SEQ ID NO: 732566 - DNA, 13 bp, C. elegans
ttagtgaaaaatc

SEQ ID NO: 732567 - DNA, 13 bp, C. elegans
ttagtgaatttca

SEQ ID NO: 732568 - DNA, 13 bp, C. elegans
ttagtgacgtcat

SEQ ID NO: 732569 - DNA, 13 bp, C. elegans
ttagtggatggat

SEQ ID NO: 732570 - DNA, 13 bp, C. elegans
ttagtgtagattt

SEQ ID NO: 732571 - DNA, 13 bp, C. elegans
ttagttatgatct

SEQ ID NO: 732572 - DNA, 13 bp, C. elegans
ttagttattcaaa

SEQ ID NO: 732573 - DNA, 13 bp, C. elegans
ttagttcaaagtt

SEQ ID NO: 732574 - DNA, 13 bp, C. elegans
ttagttcaataaa

SEQ ID NO: 732575 - DNA, 13 bp, C. elegans
ttagttctaattt

SEQ ID NO: 732576 - DNA, 13 bp, C. elegans
ttagttgaaaatt

SEQ ID NO: 732577 - DNA, 13 bp, C. elegans
ttagttgaagttt

SEQ ID NO: 732578 - DNA, 13 bp, C. elegans
ttagtttcaaagt

SEQ ID NO: 732579 - DNA, 13 bp, C. elegans
ttagtttcaattt

SEQ ID NO: 732580 - DNA, 13 bp, C. elegans
ttagtttcttctg

SEQ ID NO: 732581 - DNA, 13 bp, C. elegans
ttagtttgaaata

SEQ ID NO: 732582 - DNA, 13 bp, C. elegans
ttagttttatcaa

SEQ ID NO: 732583 - DNA, 13 bp, C. elegans
ttagttttcaaaa

SEQ ID NO: 732584 - DNA, 13 bp, C. elegans
ttagttttcaatt

SEQ ID NO: 732585 - DNA, 13 bp, C. elegans
ttagttttcatca

SEQ ID NO: 732586 - DNA, 13 bp, C. elegans
ttagttttccaat

SEQ ID NO: 732587 - DNA, 13 bp, C. elegans
ttagttttcgaga

SEQ ID NO: 732588 - DNA, 13 bp, C. elegans
ttagttttctaat

SEQ ID NO: 732589 - DNA, 13 bp, C. elegans
ttagttttgaaaa

SEQ ID NO: 732590 - DNA, 13 bp, C. elegans
ttagttttgcacc

SEQ ID NO: 732591 - DNA, 13 bp, C. elegans
ttagttttgcatt

SEQ ID NO: 732592 - DNA, 13 bp, C. elegans
ttagttttgttca

SEQ ID NO: 732593 - DNA, 13 bp, C. elegans
ttataaaacactt

SEQ ID NO: 732594 - DNA, 13 bp, C. elegans
ttataaaactgaa

SEQ ID NO: 732595 - DNA, 13 bp, C. elegans
ttataaaactgcg

SEQ ID NO: 732596 - DNA, 13 bp, C. elegans
ttataaaacttca

SEQ ID NO: 732597 - DNA, 13 bp, C. elegans
ttataaaagtttg

SEQ ID NO: 732598 - DNA, 13 bp, C. elegans
ttataaaatggaa

SEQ ID NO: 732599 - DNA, 13 bp, C. elegans
ttataaacttttc

SEQ ID NO: 732600 - DNA, 13 bp, C. elegans
ttataaagcttta

SEQ ID NO: 732601 - DNA, 13 bp, C. elegans
ttataaaggtttt

SEQ ID NO: 732602 - DNA, 13 bp, C. elegans
ttataaattggaa

SEQ ID NO: 732603 - DNA, 13 bp, C. elegans
ttataactccgtt

SEQ ID NO: 732604 - DNA, 13 bp, C. elegans
ttataactgtaaa

SEQ ID NO: 732605 - DNA, 13 bp, C. elegans
ttataagttcaaa

SEQ ID NO: 732606 - DNA, 13 bp, C. elegans
ttataagttttct

SEQ ID NO: 732607 - DNA, 13 bp, C. elegans
ttataatccaaaa

SEQ ID NO: 732608 - DNA, 13 bp, C. elegans
ttataatggaaaa

SEQ ID NO: 732609 - DNA, 13 bp, C. elegans
ttataatgtctca

SEQ ID NO: 732610 - DNA, 13 bp, C. elegans
ttataattttctg

SEQ ID NO: 732611 - DNA, 13 bp, C. elegans
ttataattttgga

SEQ ID NO: 732612 - DNA, 13 bp, C. elegans
ttatacaattttc

SEQ ID NO: 732613 - DNA, 13 bp, C. elegans
ttatacacatttt

SEQ ID NO: 732614 - DNA, 13 bp, C. elegans
ttatacagaaatt

SEQ ID NO: 732615 - DNA, 13 bp, C. elegans
ttatacagatttt

SEQ ID NO: 732616 - DNA, 13 bp, C. elegans
ttatacagtttca

SEQ ID NO: 732617 - DNA, 13 bp, C. elegans
ttatacattttcc

SEQ ID NO: 732618 - DNA, 13 bp, C. elegans
ttataccaatttt

SEQ ID NO: 732619 - DNA, 13 bp, C. elegans
ttatacgtgtatt

SEQ ID NO: 732620 - DNA, 13 bp, C. elegans
ttatactcaaaat

SEQ ID NO: 732621 - DNA, 13 bp, C. elegans
ttatactcatttc

SEQ ID NO: 732622 - DNA, 13 bp, C. elegans
ttatactcatttg

SEQ ID NO: 732623 - DNA, 13 bp, C. elegans
ttatactgaaatt

SEQ ID NO: 732624 - DNA, 13 bp, C. elegans
ttatagattttcg

SEQ ID NO: 732625 - DNA, 13 bp, C. elegans
ttatagcttaaaa

SEQ ID NO: 732626 - DNA, 13 bp, C. elegans
ttataggttttct

SEQ ID NO: 732627 - DNA, 13 bp, C. elegans
ttatagttttgga

SEQ ID NO: 732628 - DNA, 13 bp, C. elegans
ttatatacaaaca

SEQ ID NO: 732629 - DNA, 13 bp, C. elegans
ttatatcatcaaa

SEQ ID NO: 732630 - DNA, 13 bp, C. elegans
ttatatcattttg

SEQ ID NO: 732631 - DNA, 13 bp, C. elegans
ttatatccaaaaa

SEQ ID NO: 732632 - DNA, 13 bp, C. elegans
ttatatctcaatt

SEQ ID NO: 732633 - DNA, 13 bp, C. elegans
ttatatctcagtt

SEQ ID NO: 732634 - DNA, 13 bp, C. elegans
ttatatctcggtt

SEQ ID NO: 732635 - DNA, 13 bp, C. elegans
ttatatcttggtt

SEQ ID NO: 732636 - DNA, 13 bp, C. elegans
ttatattcaaaac

SEQ ID NO: 732637 - DNA, 13 bp, C. elegans
ttatattgaaaac

SEQ ID NO: 732638 - DNA, 13 bp, C. elegans
ttatattgaaaca

SEQ ID NO: 732639 - DNA, 13 bp, C. elegans
ttatattgatgag

SEQ ID NO: 732640 - DNA, 13 bp, C. elegans
ttatattgcaaaa

SEQ ID NO: 732641 - DNA, 13 bp, C. elegans
ttatattggaatt

SEQ ID NO: 732642 - DNA, 13 bp, C. elegans
ttatatttaagct

SEQ ID NO: 732643 - DNA, 13 bp, C. elegans
ttatatttcaaca

SEQ ID NO: 732644 - DNA, 13 bp, C. elegans
ttatatttcaact

SEQ ID NO: 732645 - DNA, 13 bp, C. elegans
ttatatttgaact

SEQ ID NO: 732646 - DNA, 13 bp, C. elegans
ttatatttgagct

SEQ ID NO: 732647 - DNA, 13 bp, C. elegans
ttatatttggtaa

SEQ ID NO: 732648 - DNA, 13 bp, C. elegans
ttatattttcaga

SEQ ID NO: 732649 - DNA, 13 bp, C. elegans
ttatattttccag

SEQ ID NO: 732650 - DNA, 13 bp, C. elegans
ttatattttccgt

SEQ ID NO: 732651 - DNA, 13 bp, C. elegans
ttatattttctga

SEQ ID NO: 732652 - DNA, 13 bp, C. elegans
ttatattttgaca

SEQ ID NO: 732653 - DNA, 13 bp, C. elegans
ttatcaaaaagct

SEQ ID NO: 732654 - DNA, 13 bp, C. elegans
ttatcaaaaatca

SEQ ID NO: 732655 - DNA, 13 bp, C. elegans
ttatcaaaacaca

SEQ ID NO: 732656 - DNA, 13 bp, C. elegans
ttatcaaaacatt

SEQ ID NO: 732657 - DNA, 13 bp, C. elegans
ttatcaaaacttt

SEQ ID NO: 732658 - DNA, 13 bp, C. elegans
ttatcaaaagaaa

SEQ ID NO: 732659 - DNA, 13 bp, C. elegans
ttatcaaaagacg

SEQ ID NO: 732660 - DNA, 13 bp, C. elegans
ttatcaaaatcaa

SEQ ID NO: 732661 - DNA, 13 bp, C. elegans
ttatcaaaatgaa

SEQ ID NO: 732662 - DNA, 13 bp, C. elegans
ttatcaaaattgg

SEQ ID NO: 732663 - DNA, 13 bp, C. elegans
ttatcaaaatttc

SEQ ID NO: 732664 - DNA, 13 bp, C. elegans
ttatcaaacaaat

SEQ ID NO: 732665 - DNA, 13 bp, C. elegans
ttatcaaagaaaa

SEQ ID NO: 732666 - DNA, 13 bp, C. elegans
ttatcaaatactt

SEQ ID NO: 732667 - DNA, 13 bp, C. elegans
ttatcaaatatca

SEQ ID NO: 732668 - DNA, 13 bp, C. elegans
ttatcaaatcttg

SEQ ID NO: 732669 - DNA, 13 bp, C. elegans
ttatcaaatgttt

SEQ ID NO: 732670 - DNA, 13 bp, C. elegans
ttatcaaattcga

SEQ ID NO: 732671 - DNA, 13 bp, C. elegans
ttatcaaattgaa

SEQ ID NO: 732672 - DNA, 13 bp, C. elegans
ttatcaaattgtt

SEQ ID NO: 732673 - DNA, 13 bp, C. elegans
ttatcaaatttcg

SEQ ID NO: 732674 - DNA, 13 bp, C. elegans
ttatcaacaatta

SEQ ID NO: 732675 - DNA, 13 bp, C. elegans
ttatcaacatttt

SEQ ID NO: 732676 - DNA, 13 bp, C. elegans
ttatcaactttca

SEQ ID NO: 732677 - DNA, 13 bp, C. elegans
ttatcaagaattt

SEQ ID NO: 732678 - DNA, 13 bp, C. elegans
ttatcaagatatt

SEQ ID NO: 732679 - DNA, 13 bp, C. elegans
ttatcaagattat

SEQ ID NO: 732680 - DNA, 13 bp, C. elegans
ttatcaagttttc

SEQ ID NO: 732681 - DNA, 13 bp, C. elegans
ttatcaatatttg

SEQ ID NO: 732682 - DNA, 13 bp, C. elegans
ttatcaatcaaaa

SEQ ID NO: 732683 - DNA, 13 bp, C. elegans
ttatcaatcattt

SEQ ID NO: 732684 - DNA, 13 bp, C. elegans
ttatcaatgtcgc

SEQ ID NO: 732685 - DNA, 13 bp, C. elegans
ttatcaattcaaa

SEQ ID NO: 732686 - DNA, 13 bp, C. elegans
ttatcaattgaaa

SEQ ID NO: 732687 - DNA, 13 bp, C. elegans
ttatcaattgaca

SEQ ID NO: 732688 - DNA, 13 bp, C. elegans
ttatcaatttact

SEQ ID NO: 732689 - DNA, 13 bp, C. elegans
ttatcaatttccg

SEQ ID NO: 732690 - DNA, 13 bp, C. elegans
ttatcaattttca

SEQ ID NO: 732691 - DNA, 13 bp, C. elegans
ttatcaattttga

SEQ ID NO: 732692 - DNA, 13 bp, C. elegans
ttatcaattttgt

SEQ ID NO: 732693 - DNA, 13 bp, C. elegans
ttatcacaaattt

SEQ ID NO: 732694 - DNA, 13 bp, C. elegans
ttatcacaacatt

SEQ ID NO: 732695 - DNA, 13 bp, C. elegans
ttatcacaacttt

SEQ ID NO: 732696 - DNA, 13 bp, C. elegans
ttatcacatgaaa

SEQ ID NO: 732697 - DNA, 13 bp, C. elegans
ttatcacctcgac

SEQ ID NO: 732698 - DNA, 13 bp, C. elegans
ttatcactaaaaa

SEQ ID NO: 732699 - DNA, 13 bp, C. elegans
ttatcactgataa

SEQ ID NO: 732700 - DNA, 13 bp, C. elegans
ttatcacttatca

SEQ ID NO: 732701 - DNA, 13 bp, C. elegans
ttatcagaaaaag

SEQ ID NO: 732702 - DNA, 13 bp, C. elegans
ttatcagaaattc

SEQ ID NO: 732703 - DNA, 13 bp, C. elegans
ttatcagaaattt

SEQ ID NO: 732704 - DNA, 13 bp, C. elegans
ttatcagaatttt

SEQ ID NO: 732705 - DNA, 13 bp, C. elegans
ttatcagacaaaa

SEQ ID NO: 732706 - DNA, 13 bp, C. elegans
ttatcagagaatt

SEQ ID NO: 732707 - DNA, 13 bp, C. elegans
ttatcagattttt

SEQ ID NO: 732708 - DNA, 13 bp, C. elegans
ttatcagtaaaaa

SEQ ID NO: 732709 - DNA, 13 bp, C. elegans
ttatcagtaaaat

SEQ ID NO: 732710 - DNA, 13 bp, C. elegans
ttatcagtatttt

SEQ ID NO: 732711 - DNA, 13 bp, C. elegans
ttatcagtgataa

SEQ ID NO: 732712 - DNA, 13 bp, C. elegans
ttatcagtgattt

SEQ ID NO: 732713 - DNA, 13 bp, C. elegans
ttatcagttatca

SEQ ID NO: 732714 - DNA, 13 bp, C. elegans
ttatcagttcaaa

SEQ ID NO: 732715 - DNA, 13 bp, C. elegans
ttatcagtttatc

SEQ ID NO: 732716 - DNA, 13 bp, C. elegans
ttatcagtttcaa

SEQ ID NO: 732717 - DNA, 13 bp, C. elegans
ttatcagtttctt

SEQ ID NO: 732718 - DNA, 13 bp, C. elegans
ttatcagttttaa

SEQ ID NO: 732719 - DNA, 13 bp, C. elegans
ttatcagttttct

SEQ ID NO: 732720 - DNA, 13 bp, C. elegans
ttatcagttttgc

SEQ ID NO: 732721 - DNA, 13 bp, C. elegans
ttatcagttttta

SEQ ID NO: 732722 - DNA, 13 bp, C. elegans
ttatcagtttttc

SEQ ID NO: 732723 - DNA, 13 bp, C. elegans
ttatcatcaaaat

SEQ ID NO: 732724 - DNA, 13 bp, C. elegans
ttatcatcatcat

SEQ ID NO: 732725 - DNA, 13 bp, C. elegans
ttatcattatcat

SEQ ID NO: 732726 - DNA, 13 bp, C. elegans
ttatcattatttg

SEQ ID NO: 732727 - DNA, 13 bp, C. elegans
ttatcattcaaaa

SEQ ID NO: 732728 - DNA, 13 bp, C. elegans
ttatcattcaaat

SEQ ID NO: 732729 - DNA, 13 bp, C. elegans
ttatcattgaaat

SEQ ID NO: 732730 - DNA, 13 bp, C. elegans
ttatcatttatca

SEQ ID NO: 732731 - DNA, 13 bp, C. elegans
ttatcattttgaa

SEQ ID NO: 732732 - DNA, 13 bp, C. elegans
ttatcattttgat

SEQ ID NO: 732733 - DNA, 13 bp, C. elegans
ttatcatttttcg

SEQ ID NO: 732734 - DNA, 13 bp, C. elegans
ttatcatttttga

SEQ ID NO: 732735 - DNA, 13 bp, C. elegans
ttatcatttttgc

SEQ ID NO: 732736 - DNA, 13 bp, C. elegans
ttatcatttttgg

SEQ ID NO: 732737 - DNA, 13 bp, C. elegans
ttatccaaaaatg

SEQ ID NO: 732738 - DNA, 13 bp, C. elegans
ttatccaaaacaa

SEQ ID NO: 732739 - DNA, 13 bp, C. elegans
ttatccaatttta

SEQ ID NO: 732740 - DNA, 13 bp, C. elegans
ttatccattttaa

SEQ ID NO: 732741 - DNA, 13 bp, C. elegans
ttatcccaaattt

SEQ ID NO: 732742 - DNA, 13 bp, C. elegans
ttatccgaaattt

SEQ ID NO: 732743 - DNA, 13 bp, C. elegans
ttatccgattttt

SEQ ID NO: 732744 - DNA, 13 bp, C. elegans
ttatcctgatttt

SEQ ID NO: 732745 - DNA, 13 bp, C. elegans
ttatcgaaaaatg

SEQ ID NO: 732746 - DNA, 13 bp, C. elegans
ttatcgaaaatct

SEQ ID NO: 732747 - DNA, 13 bp, C. elegans
ttatcgaaaattc

SEQ ID NO: 732748 - DNA, 13 bp, C. elegans
ttatcgagaaaat

SEQ ID NO: 732749 - DNA, 13 bp, C. elegans
ttatcgataattt

SEQ ID NO: 732750 - DNA, 13 bp, C. elegans
ttatcgattattt

SEQ ID NO: 732751 - DNA, 13 bp, C. elegans
ttatcgatttcca

SEQ ID NO: 732752 - DNA, 13 bp, C. elegans
ttatcgatttctg

SEQ ID NO: 732753 - DNA, 13 bp, C. elegans
ttatcgatttctt

SEQ ID NO: 732754 - DNA, 13 bp, C. elegans
ttatcgattttac

SEQ ID NO: 732755 - DNA, 13 bp, C. elegans
ttatcgattttcc

SEQ ID NO: 732756 - DNA, 13 bp, C. elegans
ttatcgattttgc

SEQ ID NO: 732757 - DNA, 13 bp, C. elegans
ttatcgattttta

SEQ ID NO: 732758 - DNA, 13 bp, C. elegans
ttatcgatttttc

SEQ ID NO: 732759 - DNA, 13 bp, C. elegans
ttatcggaaaata

SEQ ID NO: 732760 - DNA, 13 bp, C. elegans
ttatcggattttt

SEQ ID NO: 732761 - DNA, 13 bp, C. elegans
ttatctacttgaa

SEQ ID NO: 732762 - DNA, 13 bp, C. elegans
ttatctcaaaaag

SEQ ID NO: 732763 - DNA, 13 bp, C. elegans
ttatctcaagttc

SEQ ID NO: 732764 - DNA, 17 bp, C. elegans
ttatctcaagttctact

SEQ ID NO: 732765 - DNA, 13 bp, C. elegans
ttatctcagtgag

SEQ ID NO: 732766 - DNA, 13 bp, C. elegans
ttatctcagtttt

SEQ ID NO: 732767 - DNA, 13 bp, C. elegans
ttatctcatttaa

SEQ ID NO: 732768 - DNA, 13 bp, C. elegans
ttatctctgaaaa

SEQ ID NO: 732769 - DNA, 13 bp, C. elegans
ttatctgaaaaaa

SEQ ID NO: 732770 - DNA, 13 bp, C. elegans
ttatctgaaaaca

SEQ ID NO: 732771 - DNA, 13 bp, C. elegans
ttatctgaaaatc

SEQ ID NO: 732772 - DNA, 13 bp, C. elegans
ttatctgaaaatg

SEQ ID NO: 732773 - DNA, 13 bp, C. elegans
ttatctgaaagtt

SEQ ID NO: 732774 - DNA, 13 bp, C. elegans
ttatctgattttg

SEQ ID NO: 732775 - DNA, 13 bp, C. elegans
ttatcttaaagtt

SEQ ID NO: 732776 - DNA, 13 bp, C. elegans
ttatcttatcaat

SEQ ID NO: 732777 - DNA, 13 bp, C. elegans
ttatcttcaaaaa

SEQ ID NO: 732778 - DNA, 13 bp, C. elegans
ttatcttcaaact

SEQ ID NO: 732779 - DNA, 13 bp, C. elegans
ttatcttctgaaa

SEQ ID NO: 732780 - DNA, 13 bp, C. elegans
ttatcttgcattt

SEQ ID NO: 732781 - DNA, 13 bp, C. elegans
ttatcttgctttg

SEQ ID NO: 732782 - DNA, 13 bp, C. elegans
ttatctttcaaat

SEQ ID NO: 732783 - DNA, 13 bp, C. elegans
ttatgaaaaaaac

SEQ ID NO: 732784 - DNA, 13 bp, C. elegans
ttatgaaaaaatg

SEQ ID NO: 732785 - DNA, 13 bp, C. elegans
ttatgaaaaacaa

SEQ ID NO: 732786 - DNA, 13 bp, C. elegans
ttatgaaaaagat

SEQ ID NO: 732787 - DNA, 13 bp, C. elegans
ttatgaaaaatct

SEQ ID NO: 732788 - DNA, 13 bp, C. elegans
ttatgaaaaatgt

SEQ ID NO: 732789 - DNA, 13 bp, C. elegans
ttatgaaaagttt

SEQ ID NO: 732790 - DNA, 13 bp, C. elegans
ttatgaaacttca

SEQ ID NO: 732791 - DNA, 13 bp, C. elegans
ttatgaaagttta

SEQ ID NO: 732792 - DNA, 13 bp, C. elegans
ttatgaaatcaaa

SEQ ID NO: 732793 - DNA, 13 bp, C. elegans
ttatgaaattgct

SEQ ID NO: 732794 - DNA, 13 bp, C. elegans
ttatgaaattttc

SEQ ID NO: 732795 - DNA, 13 bp, C. elegans
ttatgaacaattt

SEQ ID NO: 732796 - DNA, 13 bp, C. elegans
ttatgaactaaaa

SEQ ID NO: 732797 - DNA, 13 bp, C. elegans
ttatgaactgaat

SEQ ID NO: 732798 - DNA, 13 bp, C. elegans
ttatgaagaatta

SEQ ID NO: 732799 - DNA, 13 bp, C. elegans
ttatgaagttttc

SEQ ID NO: 732800 - DNA, 13 bp, C. elegans
ttatgaataaact

SEQ ID NO: 732801 - DNA, 13 bp, C. elegans
ttatgaatttcaa

SEQ ID NO: 732802 - DNA, 13 bp, C. elegans
ttatgaattttca

SEQ ID NO: 732803 - DNA, 13 bp, C. elegans
ttatgacataata

SEQ ID NO: 732804 - DNA, 13 bp, C. elegans
ttatgacattttc

SEQ ID NO: 732805 - DNA, 13 bp, C. elegans
ttatgacattttt

SEQ ID NO: 732806 - DNA, 13 bp, C. elegans
ttatgactttttc

SEQ ID NO: 732807 - DNA, 13 bp, C. elegans
ttatgagaaaatt

SEQ ID NO: 732808 - DNA, 13 bp, C. elegans
ttatgagaaattt

SEQ ID NO: 732809 - DNA, 13 bp, C. elegans
ttatgagaatatt

SEQ ID NO: 732810 - DNA, 13 bp, C. elegans
ttatgataaaaac

SEQ ID NO: 732811 - DNA, 13 bp, C. elegans
ttatgatactttt

SEQ ID NO: 732812 - DNA, 13 bp, C. elegans
ttatgatattcgg

SEQ ID NO: 732813 - DNA, 13 bp, C. elegans
ttatgatatttag

SEQ ID NO: 732814 - DNA, 13 bp, C. elegans
ttatgatatttga

SEQ ID NO: 732815 - DNA, 13 bp, C. elegans
ttatgatcaaaat

SEQ ID NO: 732816 - DNA, 13 bp, C. elegans
ttatgatctgtgt

SEQ ID NO: 732817 - DNA, 13 bp, C. elegans
ttatgatgatatt

SEQ ID NO: 732818 - DNA, 13 bp, C. elegans
ttatgatgatttg

SEQ ID NO: 732819 - DNA, 13 bp, C. elegans
ttatgatgtttca

SEQ ID NO: 732820 - DNA, 13 bp, C. elegans
ttatgattatttc

SEQ ID NO: 732821 - DNA, 13 bp, C. elegans
ttatgcaaacttt

SEQ ID NO: 732822 - DNA, 13 bp, C. elegans
ttatgcaaatttc

SEQ ID NO: 732823 - DNA, 13 bp, C. elegans
ttatgcaaatttg

SEQ ID NO: 732824 - DNA, 13 bp, C. elegans
ttatgcaataatt

SEQ ID NO: 732825 - DNA, 13 bp, C. elegans
ttatgcaattttt

SEQ ID NO: 732826 - DNA, 13 bp, C. elegans
ttatgcatgtttt

SEQ ID NO: 732827 - DNA, 13 bp, C. elegans
ttatgccaaattt

SEQ ID NO: 732828 - DNA, 13 bp, C. elegans
ttatgccgaaatt

SEQ ID NO: 732829 - DNA, 13 bp, C. elegans
ttatgcttatgct

SEQ ID NO: 732830 - DNA, 13 bp, C. elegans
ttatggaaataaa

SEQ ID NO: 732831 - DNA, 13 bp, C. elegans
ttatggaaattat

SEQ ID NO: 732832 - DNA, 13 bp, C. elegans
ttatggaagaaaa

SEQ ID NO: 732833 - DNA, 13 bp, C. elegans
ttatggaataaaa

SEQ ID NO: 732834 - DNA, 13 bp, C. elegans
ttatggaattttg

SEQ ID NO: 732835 - DNA, 13 bp, C. elegans
ttatggagaatat

SEQ ID NO: 732836 - DNA, 13 bp, C. elegans
ttatggagaattt

SEQ ID NO: 732837 - DNA, 13 bp, C. elegans
ttatggattgctt

SEQ ID NO: 732838 - DNA, 13 bp, C. elegans
ttatggcggttca

SEQ ID NO: 732839 - DNA, 15 bp, C. elegans
ttatggcggttcaaa

SEQ ID NO: 732840 - DNA, 13 bp, C. elegans
ttatggtgcatcg

SEQ ID NO: 732841 - DNA, 13 bp, C. elegans
ttatggtggttca

SEQ ID NO: 732842 - DNA, 13 bp, C. elegans
ttatgtaactttt

SEQ ID NO: 732843 - DNA, 13 bp, C. elegans
ttatgtagatcaa

SEQ ID NO: 732844 - DNA, 13 bp, C. elegans
ttatgtccccatt

SEQ ID NO: 732845 - DNA, 13 bp, C. elegans
ttatgtcggctgc

SEQ ID NO: 732846 - DNA, 13 bp, C. elegans
ttatgtctgaaaa

SEQ ID NO: 732847 - DNA, 13 bp, C. elegans
ttatgtgcaagat

SEQ ID NO: 732848 - DNA, 13 bp, C. elegans
ttatgttatcaac

SEQ ID NO: 732849 - DNA, 13 bp, C. elegans
ttatgttcaaaaa

SEQ ID NO: 732850 - DNA, 13 bp, C. elegans
ttatgttccaaaa

SEQ ID NO: 732851 - DNA, 13 bp, C. elegans
ttatgttctctaa

SEQ ID NO: 732852 - DNA, 13 bp, C. elegans
ttatgtttcaaat

SEQ ID NO: 732853 - DNA, 13 bp, C. elegans
ttatgttttccag

SEQ ID NO: 732854 - DNA, 13 bp, C. elegans
ttatgttttgaaa

SEQ ID NO: 732855 - DNA, 13 bp, C. elegans
ttattaaaacttg

SEQ ID NO: 732856 - DNA, 13 bp, C. elegans
ttattaaagctca

SEQ ID NO: 732857 - DNA, 13 bp, C. elegans
ttattaaagtttc

SEQ ID NO: 732858 - DNA, 13 bp, C. elegans
ttattaaatgtgg

SEQ ID NO: 732859 - DNA, 13 bp, C. elegans
ttattaagttttc

SEQ ID NO: 732860 - DNA, 13 bp, C. elegans
ttattaattcgaa

SEQ ID NO: 732861 - DNA, 13 bp, C. elegans
ttattaatttcag

SEQ ID NO: 732862 - DNA, 13 bp, C. elegans
ttattacaaattc

SEQ ID NO: 732863 - DNA, 13 bp, C. elegans
ttattacacattc

SEQ ID NO: 732864 - DNA, 13 bp, C. elegans
ttattacagaaat

SEQ ID NO: 732865 - DNA, 13 bp, C. elegans
ttattacatcaat

SEQ ID NO: 732866 - DNA, 13 bp, C. elegans
ttattacgttttc

SEQ ID NO: 732867 - DNA, 13 bp, C. elegans
ttattactattca

SEQ ID NO: 732868 - DNA, 13 bp, C. elegans
ttattactgatat

SEQ ID NO: 732869 - DNA, 13 bp, C. elegans
ttattagaaaaac

SEQ ID NO: 732870 - DNA, 13 bp, C. elegans
ttattagaaaact

SEQ ID NO: 732871 - DNA, 13 bp, C. elegans
ttattagaaaatc

SEQ ID NO: 732872 - DNA, 13 bp, C. elegans
ttattatactcaa

SEQ ID NO: 732873 - DNA, 13 bp, C. elegans
ttattatcacatt

SEQ ID NO: 732874 - DNA, 13 bp, C. elegans
ttattatcagatt

SEQ ID NO: 732875 - DNA, 13 bp, C. elegans
ttattatcgattt

SEQ ID NO: 732876 - DNA, 13 bp, C. elegans
ttattatgacatt

SEQ ID NO: 732877 - DNA, 13 bp, C. elegans
ttattatgagaaa

SEQ ID NO: 732878 - DNA, 13 bp, C. elegans
ttattatgcaaaa

SEQ ID NO: 732879 - DNA, 13 bp, C. elegans
ttattatgcaaat

SEQ ID NO: 732880 - DNA, 13 bp, C. elegans
ttattatgcaatt

SEQ ID NO: 732881 - DNA, 13 bp, C. elegans
ttattattattcg

SEQ ID NO: 732882 - DNA, 13 bp, C. elegans
ttattattcagaa

SEQ ID NO: 732883 - DNA, 13 bp, C. elegans
ttattattcagtt

SEQ ID NO: 732884 - DNA, 13 bp, C. elegans
ttattattcgaaa

SEQ ID NO: 732885 - DNA, 13 bp, C. elegans
ttattattttcag

SEQ ID NO: 732886 - DNA, 13 bp, C. elegans
ttattattttcga

SEQ ID NO: 732887 - DNA, 13 bp, C. elegans
ttattcaaaaaca

SEQ ID NO: 732888 - DNA, 13 bp, C. elegans
ttattcaaaaagt

SEQ ID NO: 732889 - DNA, 13 bp, C. elegans
ttattcaaagaat

SEQ ID NO: 732890 - DNA, 13 bp, C. elegans
ttattcaaattca

SEQ ID NO: 732891 - DNA, 13 bp, C. elegans
ttattcaacaatt

SEQ ID NO: 732892 - DNA, 13 bp, C. elegans
ttattcaacattt

SEQ ID NO: 732893 - DNA, 13 bp, C. elegans
ttattcaagtaat

SEQ ID NO: 732894 - DNA, 13 bp, C. elegans
ttattcaataaac

SEQ ID NO: 732895 - DNA, 13 bp, C. elegans
ttattcaataact

SEQ ID NO: 732896 - DNA, 13 bp, C. elegans
ttattcaatacaa

SEQ ID NO: 732897 - DNA, 13 bp, C. elegans
ttattcaatcaaa

SEQ ID NO: 732898 - DNA, 13 bp, C. elegans
ttattcaatgttt

SEQ ID NO: 732899 - DNA, 13 bp, C. elegans
ttattcaattcaa

SEQ ID NO: 732900 - DNA, 13 bp, C. elegans
ttattcacaaaat

SEQ ID NO: 732901 - DNA, 13 bp, C. elegans
ttattcacaattt

SEQ ID NO: 732902 - DNA, 13 bp, C. elegans
ttattcacagttt

SEQ ID NO: 732903 - DNA, 13 bp, C. elegans
ttattcacttttg

SEQ ID NO: 732904 - DNA, 13 bp, C. elegans
ttattcagaaaac

SEQ ID NO: 732905 - DNA, 13 bp, C. elegans
ttattcagaaact

SEQ ID NO: 732906 - DNA, 13 bp, C. elegans
ttattcagaataa

SEQ ID NO: 732907 - DNA, 13 bp, C. elegans
ttattcatagctt

SEQ ID NO: 732908 - DNA, 13 bp, C. elegans
ttattcatatttg

SEQ ID NO: 732909 - DNA, 13 bp, C. elegans
ttattcatcactt

SEQ ID NO: 732910 - DNA, 13 bp, C. elegans
ttattcatgactt

SEQ ID NO: 732911 - DNA, 13 bp, C. elegans
ttattcatgattt

SEQ ID NO: 732912 - DNA, 13 bp, C. elegans
ttattcatgtgat

SEQ ID NO: 732913 - DNA, 13 bp, C. elegans
ttattcattcaaa

SEQ ID NO: 732914 - DNA, 13 bp, C. elegans
ttattcattcaag

SEQ ID NO: 732915 - DNA, 13 bp, C. elegans
ttattccaaaact

SEQ ID NO: 732916 - DNA, 13 bp, C. elegans
ttattccaaattt

SEQ ID NO: 732917 - DNA, 13 bp, C. elegans
ttattccaacaaa

SEQ ID NO: 732918 - DNA, 13 bp, C. elegans
ttattccagaaaa

SEQ ID NO: 732919 - DNA, 13 bp, C. elegans
ttattccagttgg

SEQ ID NO: 732920 - DNA, 13 bp, C. elegans
ttattcccgaaaa

SEQ ID NO: 732921 - DNA, 13 bp, C. elegans
ttattcgaaaaaa

SEQ ID NO: 732922 - DNA, 13 bp, C. elegans
ttattcgaaaaag

SEQ ID NO: 732923 - DNA, 13 bp, C. elegans
ttattcgagaaaa

SEQ ID NO: 732924 - DNA, 13 bp, C. elegans
ttattcgagtttt

SEQ ID NO: 732925 - DNA, 13 bp, C. elegans
ttattcgattttc

SEQ ID NO: 732926 - DNA, 13 bp, C. elegans
ttattcggaattt

SEQ ID NO: 732927 - DNA, 13 bp, C. elegans
ttattcgttgatt

SEQ ID NO: 732928 - DNA, 13 bp, C. elegans
ttattcgttttaa

SEQ ID NO: 732929 - DNA, 13 bp, C. elegans
ttattctaacaaa

SEQ ID NO: 732930 - DNA, 13 bp, C. elegans
ttattctattcaa

SEQ ID NO: 732931 - DNA, 13 bp, C. elegans
ttattctcaaaaa

SEQ ID NO: 732932 - DNA, 13 bp, C. elegans
ttattctcaaaat

SEQ ID NO: 732933 - DNA, 13 bp, C. elegans
ttattctcaagtt

SEQ ID NO: 732934 - DNA, 13 bp, C. elegans
ttattctcaataa

SEQ ID NO: 732935 - DNA, 13 bp, C. elegans
ttattctcagttt

SEQ ID NO: 732936 - DNA, 13 bp, C. elegans
ttattctcattca

SEQ ID NO: 732937 - DNA, 13 bp, C. elegans
ttattctctgaaa

SEQ ID NO: 732938 - DNA, 13 bp, C. elegans
ttattctgaaatt

SEQ ID NO: 732939 - DNA, 13 bp, C. elegans
ttattctgaattt

SEQ ID NO: 732940 - DNA, 13 bp, C. elegans
ttattcttcaaaa

SEQ ID NO: 732941 - DNA, 13 bp, C. elegans
ttattcttcaata

SEQ ID NO: 732942 - DNA, 13 bp, C. elegans
ttattcttcgaaa

SEQ ID NO: 732943 - DNA, 13 bp, C. elegans
ttattcttgaatt

SEQ ID NO: 732944 - DNA, 13 bp, C. elegans
ttattgaaaaact

SEQ ID NO: 732945 - DNA, 13 bp, C. elegans
ttattgaaaactt

SEQ ID NO: 732946 - DNA, 13 bp, C. elegans
ttattgaaaagtt

SEQ ID NO: 732947 - DNA, 13 bp, C. elegans
ttattgaaaattc

SEQ ID NO: 732948 - DNA, 13 bp, C. elegans
ttattgaaaattg

SEQ ID NO: 732949 - DNA, 13 bp, C. elegans
ttattgaaacagt

SEQ ID NO: 732950 - DNA, 13 bp, C. elegans
ttattgaaacatg

SEQ ID NO: 732951 - DNA, 13 bp, C. elegans
ttattgaaacttt

SEQ ID NO: 732952 - DNA, 13 bp, C. elegans
ttattgaaagaaa

SEQ ID NO: 732953 - DNA, 13 bp, C. elegans
ttattgaaatctt

SEQ ID NO: 732954 - DNA, 13 bp, C. elegans
ttattgaaattga

SEQ ID NO: 732955 - DNA, 13 bp, C. elegans
ttattgaatttcg

SEQ ID NO: 732956 - DNA, 13 bp, C. elegans
ttattgagaaaag

SEQ ID NO: 732957 - DNA, 13 bp, C. elegans
ttattgagaatat

SEQ ID NO: 732958 - DNA, 13 bp, C. elegans
ttattgagctttt

SEQ ID NO: 732959 - DNA, 13 bp, C. elegans
ttattgatgaatt

SEQ ID NO: 732960 - DNA, 13 bp, C. elegans
ttattgatttgaa

SEQ ID NO: 732961 - DNA, 13 bp, C. elegans
ttattgcaaaaat

SEQ ID NO: 732962 - DNA, 14 bp, C. elegans
ttattgcaaaaatt

SEQ ID NO: 732963 - DNA, 13 bp, C. elegans
ttattgcaaaact

SEQ ID NO: 732964 - DNA, 13 bp, C. elegans
ttattgcaaaata

SEQ ID NO: 732965 - DNA, 13 bp, C. elegans
ttattgcaaactt

SEQ ID NO: 732966 - DNA, 13 bp, C. elegans
ttattgcaagttt

SEQ ID NO: 732967 - DNA, 13 bp, C. elegans
ttattgcacaaaa

SEQ ID NO: 732968 - DNA, 13 bp, C. elegans
ttattgcatatat

SEQ ID NO: 732969 - DNA, 13 bp, C. elegans
ttattgcatattt

SEQ ID NO: 732970 - DNA, 13 bp, C. elegans
ttattgctgaaaa

SEQ ID NO: 732971 - DNA, 13 bp, C. elegans
ttattggaaaact

SEQ ID NO: 732972 - DNA, 13 bp, C. elegans
ttattggaaaatg

SEQ ID NO: 732973 - DNA, 13 bp, C. elegans
ttattggaaagtt

SEQ ID NO: 732974 - DNA, 13 bp, C. elegans
ttattggaaatct

SEQ ID NO: 732975 - DNA, 13 bp, C. elegans
ttattggaaatta

SEQ ID NO: 732976 - DNA, 13 bp, C. elegans
ttattgtaacaaa

SEQ ID NO: 732977 - DNA, 13 bp, C. elegans
ttattgtaacttt

SEQ ID NO: 732978 - DNA, 13 bp, C. elegans
ttattgtagaaaa

SEQ ID NO: 732979 - DNA, 13 bp, C. elegans
ttattgtcaacaa

SEQ ID NO: 732980 - DNA, 13 bp, C. elegans
ttattgtgaaaaa

SEQ ID NO: 732981 - DNA, 13 bp, C. elegans
ttattgtgaaaat

SEQ ID NO: 732982 - DNA, 13 bp, C. elegans
ttatttacatgtt

SEQ ID NO: 732983 - DNA, 13 bp, C. elegans
ttatttacgaata

SEQ ID NO: 732984 - DNA, 13 bp, C. elegans
ttatttactgaaa

SEQ ID NO: 732985 - DNA, 13 bp, C. elegans
ttatttatcacaa

SEQ ID NO: 732986 - DNA, 13 bp, C. elegans
ttatttatggaaa

SEQ ID NO: 732987 - DNA, 13 bp, C. elegans
ttatttattacag

SEQ ID NO: 732988 - DNA, 13 bp, C. elegans
ttatttattctcg

SEQ ID NO: 732989 - DNA, 13 bp, C. elegans
ttatttattgaga

SEQ ID NO: 732990 - DNA, 13 bp, C. elegans
ttatttattgtca

SEQ ID NO: 732991 - DNA, 13 bp, C. elegans
ttatttatttcag

SEQ ID NO: 732992 - DNA, 13 bp, C. elegans
ttatttatttcga

SEQ ID NO: 732993 - DNA, 13 bp, C. elegans
ttatttcaaaaca

SEQ ID NO: 732994 - DNA, 13 bp, C. elegans
ttatttcaaaagt

SEQ ID NO: 732995 - DNA, 13 bp, C. elegans
ttatttcaaaatc

SEQ ID NO: 732996 - DNA, 13 bp, C. elegans
ttatttcaagaat

SEQ ID NO: 732997 - DNA, 13 bp, C. elegans
ttatttcaatact

SEQ ID NO: 732998 - DNA, 13 bp, C. elegans
ttatttcacaaaa

SEQ ID NO: 732999 - DNA, 13 bp, C. elegans
ttatttcagtatt

SEQ ID NO: 733000 - DNA, 13 bp, C. elegans
ttatttcagttta

SEQ ID NO: 733001 - DNA, 13 bp, C. elegans
ttatttcatgaaa

SEQ ID NO: 733002 - DNA, 13 bp, C. elegans
ttatttcatgtaa

SEQ ID NO: 733003 - DNA, 13 bp, C. elegans
ttatttcatttga

SEQ ID NO: 733004 - DNA, 13 bp, C. elegans
ttatttccaaaaa

SEQ ID NO: 733005 - DNA, 13 bp, C. elegans
ttatttccaaaac

SEQ ID NO: 733006 - DNA, 13 bp, C. elegans
ttatttccaaaat

SEQ ID NO: 733007 - DNA, 13 bp, C. elegans
ttatttccaaata

SEQ ID NO: 733008 - DNA, 13 bp, C. elegans
ttatttccaacaa

SEQ ID NO: 733009 - DNA, 13 bp, C. elegans
ttatttcccaaat

SEQ ID NO: 733010 - DNA, 13 bp, C. elegans
ttatttcgaaaaa

SEQ ID NO: 733011 - DNA, 13 bp, C. elegans
ttatttcgaaact

SEQ ID NO: 733012 - DNA, 13 bp, C. elegans
ttatttcgaagaa

SEQ ID NO: 733013 - DNA, 13 bp, C. elegans
ttatttcgaattt

SEQ ID NO: 733014 - DNA, 13 bp, C. elegans
ttatttcggtttg

SEQ ID NO: 733015 - DNA, 13 bp, C. elegans
ttatttctaatca

SEQ ID NO: 733016 - DNA, 13 bp, C. elegans
ttatttctacaaa

SEQ ID NO: 733017 - DNA, 13 bp, C. elegans
ttatttctacagt

SEQ ID NO: 733018 - DNA, 13 bp, C. elegans
ttatttctctcaa

SEQ ID NO: 733019 - DNA, 13 bp, C. elegans
ttatttctggaaa

SEQ ID NO: 733020 - DNA, 13 bp, C. elegans
ttatttgaaaaac

SEQ ID NO: 733021 - DNA, 13 bp, C. elegans
ttatttgaaaaca

SEQ ID NO: 733022 - DNA, 13 bp, C. elegans
ttatttgaaaagt

SEQ ID NO: 733023 - DNA, 13 bp, C. elegans
ttatttgaaaatc

SEQ ID NO: 733024 - DNA, 13 bp, C. elegans
ttatttgaaacgt

SEQ ID NO: 733025 - DNA, 13 bp, C. elegans
ttatttgaaacta

SEQ ID NO: 733026 - DNA, 13 bp, C. elegans
ttatttgaaactg

SEQ ID NO: 733027 - DNA, 13 bp, C. elegans
ttatttgaaactt

SEQ ID NO: 733028 - DNA, 13 bp, C. elegans
ttatttgaacaat

SEQ ID NO: 733029 - DNA, 13 bp, C. elegans
ttatttgaactta

SEQ ID NO: 733030 - DNA, 13 bp, C. elegans
ttatttgaagaaa

SEQ ID NO: 733031 - DNA, 13 bp, C. elegans
ttatttgaatgat

SEQ ID NO: 733032 - DNA, 13 bp, C. elegans
ttatttgacattt

SEQ ID NO: 733033 - DNA, 13 bp, C. elegans
ttatttgagctca

SEQ ID NO: 733034 - DNA, 13 bp, C. elegans
ttatttgatacaa

SEQ ID NO: 733035 - DNA, 13 bp, C. elegans
ttatttgatagaa

SEQ ID NO: 733036 - DNA, 13 bp, C. elegans
ttatttgatcaaa

SEQ ID NO: 733037 - DNA, 13 bp, C. elegans
ttatttgcaaaaa

SEQ ID NO: 733038 - DNA, 13 bp, C. elegans
ttatttgcaaata

SEQ ID NO: 733039 - DNA, 13 bp, C. elegans
ttatttgctcaaa

SEQ ID NO: 733040 - DNA, 13 bp, C. elegans
ttatttggaaaat

SEQ ID NO: 733041 - DNA, 13 bp, C. elegans
ttatttggagacc

SEQ ID NO: 733042 - DNA, 13 bp, C. elegans
ttatttggatcaa

SEQ ID NO: 733043 - DNA, 13 bp, C. elegans
ttatttgtcaaaa

SEQ ID NO: 733044 - DNA, 13 bp, C. elegans
ttatttgtcacaa

SEQ ID NO: 733045 - DNA, 13 bp, C. elegans
ttatttgtgacac

SEQ ID NO: 733046 - DNA, 13 bp, C. elegans
ttatttgtgcccc

SEQ ID NO: 733047 - DNA, 13 bp, C. elegans
ttatttgttcaca

SEQ ID NO: 733048 - DNA, 13 bp, C. elegans
ttatttgttggaa

SEQ ID NO: 733049 - DNA, 13 bp, C. elegans
ttattttaaacca

SEQ ID NO: 733050 - DNA, 13 bp, C. elegans
ttattttacaact

SEQ ID NO: 733051 - DNA, 13 bp, C. elegans
ttattttacatac

SEQ ID NO: 733052 - DNA, 13 bp, C. elegans
ttattttattgca

SEQ ID NO: 733053 - DNA, 13 bp, C. elegans
ttattttcaaaag

SEQ ID NO: 733054 - DNA, 13 bp, C. elegans
ttattttcaaatc

SEQ ID NO: 733055 - DNA, 13 bp, C. elegans
ttattttcaacat

SEQ ID NO: 733056 - DNA, 13 bp, C. elegans
ttattttcaatgt

SEQ ID NO: 733057 - DNA, 13 bp, C. elegans
ttattttcagaaa

SEQ ID NO: 733058 - DNA, 13 bp, C. elegans
ttattttcagaat

SEQ ID NO: 733059 - DNA, 13 bp, C. elegans
ttattttcagatg

SEQ ID NO: 733060 - DNA, 13 bp, C. elegans
ttattttcagatt

SEQ ID NO: 733061 - DNA, 13 bp, C. elegans
ttattttcatatg

SEQ ID NO: 733062 - DNA, 13 bp, C. elegans
ttattttcatcaa

SEQ ID NO: 733063 - DNA, 13 bp, C. elegans
ttattttcattga

SEQ ID NO: 733064 - DNA, 13 bp, C. elegans
ttattttcccgtt

SEQ ID NO: 733065 - DNA, 13 bp, C. elegans
ttattttccgaaa

SEQ ID NO: 733066 - DNA, 13 bp, C. elegans
ttattttcgacaa

SEQ ID NO: 733067 - DNA, 13 bp, C. elegans
ttattttcgccga

SEQ ID NO: 733068 - DNA, 13 bp, C. elegans
ttattttctaaac

SEQ ID NO: 733069 - DNA, 13 bp, C. elegans
ttattttctagaa

SEQ ID NO: 733070 - DNA, 13 bp, C. elegans
ttattttctaggc

SEQ ID NO: 733071 - DNA, 13 bp, C. elegans
ttattttctcagt

SEQ ID NO: 733072 - DNA, 13 bp, C. elegans
ttattttctgaga

SEQ ID NO: 733073 - DNA, 13 bp, C. elegans
ttattttgaaaag

SEQ ID NO: 733074 - DNA, 13 bp, C. elegans
ttattttgaaatg

SEQ ID NO: 733075 - DNA, 13 bp, C. elegans
ttattttgaagct

SEQ ID NO: 733076 - DNA, 13 bp, C. elegans
ttattttgaattc

SEQ ID NO: 733077 - DNA, 13 bp, C. elegans
ttattttgcaaaa

SEQ ID NO: 733078 - DNA, 13 bp, C. elegans
ttattttgcgaaa

SEQ ID NO: 733079 - DNA, 13 bp, C. elegans
ttattttgctaat

SEQ ID NO: 733080 - DNA, 13 bp, C. elegans
ttattttggaaca

SEQ ID NO: 733081 - DNA, 13 bp, C. elegans
ttattttggcacc

SEQ ID NO: 733082 - DNA, 13 bp, C. elegans
ttatttttaagca

SEQ ID NO: 733083 - DNA, 13 bp, C. elegans
ttatttttcaaga

SEQ ID NO: 733084 - DNA, 13 bp, C. elegans
ttatttttccaaa

SEQ ID NO: 733085 - DNA, 13 bp, C. elegans
ttatttttcgcca

SEQ ID NO: 733086 - DNA, 13 bp, C. elegans
ttatttttctcag

SEQ ID NO: 733087 - DNA, 13 bp, C. elegans
ttatttttgaaac

SEQ ID NO: 733088 - DNA, 13 bp, C. elegans
ttatttttgaact

SEQ ID NO: 733089 - DNA, 13 bp, C. elegans
ttatttttgacaa

SEQ ID NO: 733090 - DNA, 13 bp, C. elegans
ttatttttgacag

SEQ ID NO: 733091 - DNA, 13 bp, C. elegans
ttatttttgatca

SEQ ID NO: 733092 - DNA, 13 bp, C. elegans
ttatttttgccca

SEQ ID NO: 733093 - DNA, 13 bp, C. elegans
ttatttttgctaa

SEQ ID NO: 733094 - DNA, 13 bp, C. elegans
ttattttttgcaa

SEQ ID NO: 733095 - DNA, 13 bp, C. elegans
ttattttttggca

SEQ ID NO: 733096 - DNA, 13 bp, C. elegans
ttcaaaaaaaagt

SEQ ID NO: 733097 - DNA, 13 bp, C. elegans
ttcaaaaaaatcg

SEQ ID NO: 733098 - DNA, 13 bp, C. elegans
ttcaaaaaaatgc

SEQ ID NO: 733099 - DNA, 13 bp, C. elegans
ttcaaaaaaatgt

SEQ ID NO: 733100 - DNA, 13 bp, C. elegans
ttcaaaaaacact

SEQ ID NO: 733101 - DNA, 13 bp, C. elegans
ttcaaaaaacaga

SEQ ID NO: 733102 - DNA, 13 bp, C. elegans
ttcaaaaaacccg

SEQ ID NO: 733103 - DNA, 13 bp, C. elegans
ttcaaaaaaccga

SEQ ID NO: 733104 - DNA, 13 bp, C. elegans
ttcaaaaaacgca

SEQ ID NO: 733105 - DNA, 13 bp, C. elegans
ttcaaaaaactca

SEQ ID NO: 733106 - DNA, 13 bp, C. elegans
ttcaaaaaagatg

SEQ ID NO: 733107 - DNA, 13 bp, C. elegans
ttcaaaaaagcaa

SEQ ID NO: 733108 - DNA, 13 bp, C. elegans
ttcaaaaaagcca

SEQ ID NO: 733109 - DNA, 13 bp, C. elegans
ttcaaaaaagcct

SEQ ID NO: 733110 - DNA, 13 bp, C. elegans
ttcaaaaaagtaa

SEQ ID NO: 733111 - DNA, 13 bp, C. elegans
ttcaaaaaagtta

SEQ ID NO: 733112 - DNA, 13 bp, C. elegans
ttcaaaaaatacc

SEQ ID NO: 733113 - DNA, 13 bp, C. elegans
ttcaaaaaatcac

SEQ ID NO: 733114 - DNA, 13 bp, C. elegans
ttcaaaaaatcat

SEQ ID NO: 733115 - DNA, 13 bp, C. elegans
ttcaaaaaatcct

SEQ ID NO: 733116 - DNA, 13 bp, C. elegans
ttcaaaaaatcga

SEQ ID NO: 733117 - DNA, 13 bp, C. elegans
ttcaaaaaatcta

SEQ ID NO: 733118 - DNA, 13 bp, C. elegans
ttcaaaaaatctg

SEQ ID NO: 733119 - DNA, 13 bp, C. elegans
ttcaaaaaatgtg

SEQ ID NO: 733120 - DNA, 13 bp, C. elegans
ttcaaaaaatgtt

SEQ ID NO: 733121 - DNA, 13 bp, C. elegans
ttcaaaaaattac

SEQ ID NO: 733122 - DNA, 13 bp, C. elegans
ttcaaaaaattcc

SEQ ID NO: 733123 - DNA, 13 bp, C. elegans
ttcaaaaaattct

SEQ ID NO: 733124 - DNA, 13 bp, C. elegans
ttcaaaaaattgt

SEQ ID NO: 733125 - DNA, 13 bp, C. elegans
ttcaaaaaatttc

SEQ ID NO: 733126 - DNA, 14 bp, C. elegans
ttcaaaaaatttgt

SEQ ID NO: 733127 - DNA, 13 bp, C. elegans
ttcaaaaacaatt

SEQ ID NO: 733128 - DNA, 13 bp, C. elegans
ttcaaaaacagat

SEQ ID NO: 733129 - DNA, 13 bp, C. elegans
ttcaaaaacatac

SEQ ID NO: 733130 - DNA, 13 bp, C. elegans
ttcaaaaacatgt

SEQ ID NO: 733131 - DNA, 13 bp, C. elegans
ttcaaaaacccat

SEQ ID NO: 733132 - DNA, 13 bp, C. elegans
ttcaaaaacctta

SEQ ID NO: 733133 - DNA, 13 bp, C. elegans
ttcaaaaacgaac

SEQ ID NO: 733134 - DNA, 13 bp, C. elegans
ttcaaaaacgaga

SEQ ID NO: 733135 - DNA, 13 bp, C. elegans
ttcaaaaacgtaa

SEQ ID NO: 733136 - DNA, 13 bp, C. elegans
ttcaaaaacgtta

SEQ ID NO: 733137 - DNA, 13 bp, C. elegans
ttcaaaaactaga

SEQ ID NO: 733138 - DNA, 13 bp, C. elegans
ttcaaaaactcaa

SEQ ID NO: 733139 - DNA, 13 bp, C. elegans
ttcaaaaactcac

SEQ ID NO: 733140 - DNA, 13 bp, C. elegans
ttcaaaaactcga

SEQ ID NO: 733141 - DNA, 13 bp, C. elegans
ttcaaaaactgaa

SEQ ID NO: 733142 - DNA, 14 bp, C. elegans
ttcaaaaactgaaa

SEQ ID NO: 733143 - DNA, 13 bp, C. elegans
ttcaaaaactgat

SEQ ID NO: 733144 - DNA, 13 bp, C. elegans
ttcaaaaactgct

SEQ ID NO: 733145 - DNA, 13 bp, C. elegans
ttcaaaaactgga

SEQ ID NO: 733146 - DNA, 13 bp, C. elegans
ttcaaaaactgtc

SEQ ID NO: 733147 - DNA, 13 bp, C. elegans
ttcaaaaacttaa

SEQ ID NO: 733148 - DNA, 13 bp, C. elegans
ttcaaaaacttcc

SEQ ID NO: 733149 - DNA, 13 bp, C. elegans
ttcaaaaactttg

SEQ ID NO: 733150 - DNA, 13 bp, C. elegans
ttcaaaaactttt

SEQ ID NO: 733151 - DNA, 13 bp, C. elegans
ttcaaaaagaagt

SEQ ID NO: 733152 - DNA, 13 bp, C. elegans
ttcaaaaagagaa

SEQ ID NO: 733153 - DNA, 13 bp, C. elegans
ttcaaaaagattt

SEQ ID NO: 733154 - DNA, 13 bp, C. elegans
ttcaaaaagcaaa

SEQ ID NO: 733155 - DNA, 13 bp, C. elegans
ttcaaaaagcttc

SEQ ID NO: 733156 - DNA, 13 bp, C. elegans
ttcaaaaagcttg

SEQ ID NO: 733157 - DNA, 13 bp, C. elegans
ttcaaaaaggaat

SEQ ID NO: 733158 - DNA, 13 bp, C. elegans
ttcaaaaaggtgt

SEQ ID NO: 733159 - DNA, 13 bp, C. elegans
ttcaaaaagtcaa

SEQ ID NO: 733160 - DNA, 13 bp, C. elegans
ttcaaaaagtcag

SEQ ID NO: 733161 - DNA, 13 bp, C. elegans
ttcaaaaagtctt

SEQ ID NO: 733162 - DNA, 13 bp, C. elegans
ttcaaaaagtgac

SEQ ID NO: 733163 - DNA, 13 bp, C. elegans
ttcaaaaagtgat

SEQ ID NO: 733164 - DNA, 13 bp, C. elegans
ttcaaaaagtggc

SEQ ID NO: 733165 - DNA, 13 bp, C. elegans
ttcaaaaagtggt

SEQ ID NO: 733166 - DNA, 13 bp, C. elegans
ttcaaaaagttat

SEQ ID NO: 733167 - DNA, 13 bp, C. elegans
ttcaaaaagttca

SEQ ID NO: 733168 - DNA, 13 bp, C. elegans
ttcaaaaagttgc

SEQ ID NO: 733169 - DNA, 13 bp, C. elegans
ttcaaaaagttgt

SEQ ID NO: 733170 - DNA, 13 bp, C. elegans
ttcaaaaagtttc

SEQ ID NO: 733171 - DNA, 13 bp, C. elegans
ttcaaaaagtttt

SEQ ID NO: 733172 - DNA, 13 bp, C. elegans
ttcaaaaatacat

SEQ ID NO: 733173 - DNA, 13 bp, C. elegans
ttcaaaaatagaa

SEQ ID NO: 733174 - DNA, 13 bp, C. elegans
ttcaaaaatatag

SEQ ID NO: 733175 - DNA, 13 bp, C. elegans
ttcaaaaatatgc

SEQ ID NO: 733176 - DNA, 13 bp, C. elegans
ttcaaaaatatgg

SEQ ID NO: 733177 - DNA, 13 bp, C. elegans
ttcaaaaatcaat

SEQ ID NO: 733178 - DNA, 13 bp, C. elegans
ttcaaaaatcata

SEQ ID NO: 733179 - DNA, 13 bp, C. elegans
ttcaaaaatccaa

SEQ ID NO: 733180 - DNA, 13 bp, C. elegans
ttcaaaaatccat

SEQ ID NO: 733181 - DNA, 13 bp, C. elegans
ttcaaaaatccca

SEQ ID NO: 733182 - DNA, 13 bp, C. elegans
ttcaaaaatccgt

SEQ ID NO: 733183 - DNA, 13 bp, C. elegans
ttcaaaaatcctt

SEQ ID NO: 733184 - DNA, 13 bp, C. elegans
ttcaaaaatcgag

SEQ ID NO: 733185 - DNA, 13 bp, C. elegans
ttcaaaaatcgca

SEQ ID NO: 733186 - DNA, 13 bp, C. elegans
ttcaaaaatctaa

SEQ ID NO: 733187 - DNA, 13 bp, C. elegans
ttcaaaaatcttt

SEQ ID NO: 733188 - DNA, 13 bp, C. elegans
ttcaaaaatgaaa

SEQ ID NO: 733189 - DNA, 13 bp, C. elegans
ttcaaaaatgact

SEQ ID NO: 733190 - DNA, 13 bp, C. elegans
ttcaaaaatgatc

SEQ ID NO: 733191 - DNA, 13 bp, C. elegans
ttcaaaaatgatt

SEQ ID NO: 733192 - DNA, 13 bp, C. elegans
ttcaaaaatgctg

SEQ ID NO: 733193 - DNA, 13 bp, C. elegans
ttcaaaaatgtga

SEQ ID NO: 733194 - DNA, 13 bp, C. elegans
ttcaaaaatgttc

SEQ ID NO: 733195 - DNA, 13 bp, C. elegans
ttcaaaaattact

SEQ ID NO: 733196 - DNA, 13 bp, C. elegans
ttcaaaaattagt

SEQ ID NO: 733197 - DNA, 13 bp, C. elegans
ttcaaaaattcaa

SEQ ID NO: 733198 - DNA, 13 bp, C. elegans
ttcaaaaattcca

SEQ ID NO: 733199 - DNA, 13 bp, C. elegans
ttcaaaaattcgt

SEQ ID NO: 733200 - DNA, 13 bp, C. elegans
ttcaaaaattggc

SEQ ID NO: 733201 - DNA, 13 bp, C. elegans
ttcaaaaattgtt

SEQ ID NO: 733202 - DNA, 13 bp, C. elegans
ttcaaaaatttca

SEQ ID NO: 733203 - DNA, 14 bp, C. elegans
ttcaaaaatttgaa

SEQ ID NO: 733204 - DNA, 13 bp, C. elegans
ttcaaaaattttg

SEQ ID NO: 733205 - DNA, 13 bp, C. elegans
ttcaaaacaaccg

SEQ ID NO: 733206 - DNA, 13 bp, C. elegans
ttcaaaacaagaa

SEQ ID NO: 733207 - DNA, 13 bp, C. elegans
ttcaaaacacaat

SEQ ID NO: 733208 - DNA, 13 bp, C. elegans
ttcaaaacagaat

SEQ ID NO: 733209 - DNA, 13 bp, C. elegans
ttcaaaacagtat

SEQ ID NO: 733210 - DNA, 13 bp, C. elegans
ttcaaaacatatt

SEQ ID NO: 733211 - DNA, 13 bp, C. elegans
ttcaaaacatctt

SEQ ID NO: 733212 - DNA, 13 bp, C. elegans
ttcaaaacattaa

SEQ ID NO: 733213 - DNA, 13 bp, C. elegans
ttcaaaacattct

SEQ ID NO: 733214 - DNA, 13 bp, C. elegans
ttcaaaacattga

SEQ ID NO: 733215 - DNA, 13 bp, C. elegans
ttcaaaacattgc

SEQ ID NO: 733216 - DNA, 13 bp, C. elegans
ttcaaaacatttg

SEQ ID NO: 733217 - DNA, 13 bp, C. elegans
ttcaaaacatttt

SEQ ID NO: 733218 - DNA, 13 bp, C. elegans
ttcaaaaccaaat

SEQ ID NO: 733219 - DNA, 13 bp, C. elegans
ttcaaaaccaaca

SEQ ID NO: 733220 - DNA, 13 bp, C. elegans
ttcaaaaccagaa

SEQ ID NO: 733221 - DNA, 13 bp, C. elegans
ttcaaaacgaaaa

SEQ ID NO: 733222 - DNA, 13 bp, C. elegans
ttcaaaacgtaaa

SEQ ID NO: 733223 - DNA, 13 bp, C. elegans
ttcaaaacgtcag

SEQ ID NO: 733224 - DNA, 13 bp, C. elegans
ttcaaaactacag

SEQ ID NO: 733225 - DNA, 13 bp, C. elegans
ttcaaaactagaa

SEQ ID NO: 733226 - DNA, 13 bp, C. elegans
ttcaaaactataa

SEQ ID NO: 733227 - DNA, 13 bp, C. elegans
ttcaaaactatca

SEQ ID NO: 733228 - DNA, 13 bp, C. elegans
ttcaaaactattt

SEQ ID NO: 733229 - DNA, 13 bp, C. elegans
ttcaaaactcaaa

SEQ ID NO: 733230 - DNA, 13 bp, C. elegans
ttcaaaactcttt

SEQ ID NO: 733231 - DNA, 13 bp, C. elegans
ttcaaaactgata

SEQ ID NO: 733232 - DNA, 13 bp, C. elegans
ttcaaaactgatt

SEQ ID NO: 733233 - DNA, 13 bp, C. elegans
ttcaaaactggaa

SEQ ID NO: 733234 - DNA, 13 bp, C. elegans
ttcaaaactgtca

SEQ ID NO: 733235 - DNA, 13 bp, C. elegans
ttcaaaactgtga

SEQ ID NO: 733236 - DNA, 13 bp, C. elegans
ttcaaaacttcga

SEQ ID NO: 733237 - DNA, 13 bp, C. elegans
ttcaaaacttctg

SEQ ID NO: 733238 - DNA, 13 bp, C. elegans
ttcaaaacttctt

SEQ ID NO: 733239 - DNA, 13 bp, C. elegans
ttcaaaacttgga

SEQ ID NO: 733240 - DNA, 13 bp, C. elegans
ttcaaaacttgtt

SEQ ID NO: 733241 - DNA, 13 bp, C. elegans
ttcaaaactttat

SEQ ID NO: 733242 - DNA, 13 bp, C. elegans
ttcaaaactttca

SEQ ID NO: 733243 - DNA, 13 bp, C. elegans
ttcaaaactttta

SEQ ID NO: 733244 - DNA, 13 bp, C. elegans
ttcaaaacttttc

SEQ ID NO: 733245 - DNA, 13 bp, C. elegans
ttcaaaagaaatt

SEQ ID NO: 733246 - DNA, 13 bp, C. elegans
ttcaaaagaattc

SEQ ID NO: 733247 - DNA, 13 bp, C. elegans
ttcaaaagacaaa

SEQ ID NO: 733248 - DNA, 13 bp, C. elegans
ttcaaaagacaat

SEQ ID NO: 733249 - DNA, 13 bp, C. elegans
ttcaaaagacgaa

SEQ ID NO: 733250 - DNA, 13 bp, C. elegans
ttcaaaagcaaaa

SEQ ID NO: 733251 - DNA, 13 bp, C. elegans
ttcaaaagcttct

SEQ ID NO: 733252 - DNA, 13 bp, C. elegans
ttcaaaagcttgt

SEQ ID NO: 733253 - DNA, 13 bp, C. elegans
ttcaaaaggattt

SEQ ID NO: 733254 - DNA, 13 bp, C. elegans
ttcaaaagtaaca

SEQ ID NO: 733255 - DNA, 13 bp, C. elegans
ttcaaaagtacaa

SEQ ID NO: 733256 - DNA, 13 bp, C. elegans
ttcaaaagtatca

SEQ ID NO: 733257 - DNA, 13 bp, C. elegans
ttcaaaagtggaa

SEQ ID NO: 733258 - DNA, 13 bp, C. elegans
ttcaaaagtgtaa

SEQ ID NO: 733259 - DNA, 13 bp, C. elegans
ttcaaaagtgtca

SEQ ID NO: 733260 - DNA, 13 bp, C. elegans
ttcaaaagttaat

SEQ ID NO: 733261 - DNA, 13 bp, C. elegans
ttcaaaagttatt

SEQ ID NO: 733262 - DNA, 13 bp, C. elegans
ttcaaaagttcaa

SEQ ID NO: 733263 - DNA, 13 bp, C. elegans
ttcaaaagttcac

SEQ ID NO: 733264 - DNA, 13 bp, C. elegans
ttcaaaagtttat

SEQ ID NO: 733265 - DNA, 13 bp, C. elegans
ttcaaaagtttcc

SEQ ID NO: 733266 - DNA, 13 bp, C. elegans
ttcaaaagtttga

SEQ ID NO: 733267 - DNA, 13 bp, C. elegans
ttcaaaagttttt

SEQ ID NO: 733268 - DNA, 13 bp, C. elegans
ttcaaaataacat

SEQ ID NO: 733269 - DNA, 13 bp, C. elegans
ttcaaaataactt

SEQ ID NO: 733270 - DNA, 13 bp, C. elegans
ttcaaaataagtt

SEQ ID NO: 733271 - DNA, 13 bp, C. elegans
ttcaaaataatca

SEQ ID NO: 733272 - DNA, 13 bp, C. elegans
ttcaaaatagaaa

SEQ ID NO: 733273 - DNA, 13 bp, C. elegans
ttcaaaatagaag

SEQ ID NO: 733274 - DNA, 13 bp, C. elegans
ttcaaaatagtaa

SEQ ID NO: 733275 - DNA, 13 bp, C. elegans
ttcaaaatagtca

SEQ ID NO: 733276 - DNA, 13 bp, C. elegans
ttcaaaatagttt

SEQ ID NO: 733277 - DNA, 13 bp, C. elegans
ttcaaaatatcaa

SEQ ID NO: 733278 - DNA, 13 bp, C. elegans
ttcaaaatatcca

SEQ ID NO: 733279 - DNA, 13 bp, C. elegans
ttcaaaatatgta

SEQ ID NO: 733280 - DNA, 13 bp, C. elegans
ttcaaaatattca

SEQ ID NO: 733281 - DNA, 13 bp, C. elegans
ttcaaaatattcc

SEQ ID NO: 733282 - DNA, 13 bp, C. elegans
ttcaaaatattct

SEQ ID NO: 733283 - DNA, 13 bp, C. elegans
ttcaaaatatttc

SEQ ID NO: 733284 - DNA, 13 bp, C. elegans
ttcaaaatcaaag

SEQ ID NO: 733285 - DNA, 13 bp, C. elegans
ttcaaaatcacat

SEQ ID NO: 733286 - DNA, 13 bp, C. elegans
ttcaaaatcagaa

SEQ ID NO: 733287 - DNA, 13 bp, C. elegans
ttcaaaatcatca

SEQ ID NO: 733288 - DNA, 13 bp, C. elegans
ttcaaaatcattt

SEQ ID NO: 733289 - DNA, 13 bp, C. elegans
ttcaaaatcccaa

SEQ ID NO: 733290 - DNA, 13 bp, C. elegans
ttcaaaatccgac

SEQ ID NO: 733291 - DNA, 13 bp, C. elegans
ttcaaaatctatt

SEQ ID NO: 733292 - DNA, 13 bp, C. elegans
ttcaaaatctgaa

SEQ ID NO: 733293 - DNA, 13 bp, C. elegans
ttcaaaatctgga

SEQ ID NO: 733294 - DNA, 13 bp, C. elegans
ttcaaaatcttaa

SEQ ID NO: 733295 - DNA, 13 bp, C. elegans
ttcaaaatcttct

SEQ ID NO: 733296 - DNA, 13 bp, C. elegans
ttcaaaatcttgc

SEQ ID NO: 733297 - DNA, 13 bp, C. elegans
ttcaaaatgaaat

SEQ ID NO: 733298 - DNA, 13 bp, C. elegans
ttcaaaatgaact

SEQ ID NO: 733299 - DNA, 13 bp, C. elegans
ttcaaaatgaata

SEQ ID NO: 733300 - DNA, 13 bp, C. elegans
ttcaaaatgaatt

SEQ ID NO: 733301 - DNA, 13 bp, C. elegans
ttcaaaatgacac

SEQ ID NO: 733302 - DNA, 13 bp, C. elegans
ttcaaaatgagta

SEQ ID NO: 733303 - DNA, 13 bp, C. elegans
ttcaaaatgattt

SEQ ID NO: 733304 - DNA, 13 bp, C. elegans
ttcaaaatgcaaa

SEQ ID NO: 733305 - DNA, 13 bp, C. elegans
ttcaaaatgccaa

SEQ ID NO: 733306 - DNA, 13 bp, C. elegans
ttcaaaatgctcc

SEQ ID NO: 733307 - DNA, 13 bp, C. elegans
ttcaaaatgcttc

SEQ ID NO: 733308 - DNA, 13 bp, C. elegans
ttcaaaatgtatc

SEQ ID NO: 733309 - DNA, 13 bp, C. elegans
ttcaaaatgtatg

SEQ ID NO: 733310 - DNA, 13 bp, C. elegans
ttcaaaatgtatt

SEQ ID NO: 733311 - DNA, 13 bp, C. elegans
ttcaaaatgtcaa

SEQ ID NO: 733312 - DNA, 13 bp, C. elegans
ttcaaaatgtcac

SEQ ID NO: 733313 - DNA, 13 bp, C. elegans
ttcaaaatgtgaa

SEQ ID NO: 733314 - DNA, 13 bp, C. elegans
ttcaaaatgtgga

SEQ ID NO: 733315 - DNA, 13 bp, C. elegans
ttcaaaatgtgtt

SEQ ID NO: 733316 - DNA, 13 bp, C. elegans
ttcaaaatgttca

SEQ ID NO: 733317 - DNA, 13 bp, C. elegans
ttcaaaatgttgt

SEQ ID NO: 733318 - DNA, 13 bp, C. elegans
ttcaaaatgtttg

SEQ ID NO: 733319 - DNA, 13 bp, C. elegans
ttcaaaattaact

SEQ ID NO: 733320 - DNA, 13 bp, C. elegans
ttcaaaattaatc

SEQ ID NO: 733321 - DNA, 13 bp, C. elegans
ttcaaaattacat

SEQ ID NO: 733322 - DNA, 13 bp, C. elegans
ttcaaaattagaa

SEQ ID NO: 733323 - DNA, 13 bp, C. elegans
ttcaaaattatca

SEQ ID NO: 733324 - DNA, 13 bp, C. elegans
ttcaaaattatga

SEQ ID NO: 733325 - DNA, 13 bp, C. elegans
ttcaaaattatgc

SEQ ID NO: 733326 - DNA, 13 bp, C. elegans
ttcaaaattcctc

SEQ ID NO: 733327 - DNA, 13 bp, C. elegans
ttcaaaattctat

SEQ ID NO: 733328 - DNA, 13 bp, C. elegans
ttcaaaattctca

SEQ ID NO: 733329 - DNA, 13 bp, C. elegans
ttcaaaattgaaa

SEQ ID NO: 733330 - DNA, 13 bp, C. elegans
ttcaaaattgact

SEQ ID NO: 733331 - DNA, 13 bp, C. elegans
ttcaaaattgaga

SEQ ID NO: 733332 - DNA, 13 bp, C. elegans
ttcaaaattgtat

SEQ ID NO: 733333 - DNA, 13 bp, C. elegans
ttcaaaattgtta

SEQ ID NO: 733334 - DNA, 13 bp, C. elegans
ttcaaaattgttt

SEQ ID NO: 733335 - DNA, 13 bp, C. elegans
ttcaaaatttaac

SEQ ID NO: 733336 - DNA, 13 bp, C. elegans
ttcaaaatttcaa

SEQ ID NO: 733337 - DNA, 13 bp, C. elegans
ttcaaaatttcac

SEQ ID NO: 733338 - DNA, 13 bp, C. elegans
ttcaaaatttcag

SEQ ID NO: 733339 - DNA, 13 bp, C. elegans
ttcaaaatttcat

SEQ ID NO: 733340 - DNA, 13 bp, C. elegans
ttcaaaatttcca

SEQ ID NO: 733341 - DNA, 13 bp, C. elegans
ttcaaaatttccg

SEQ ID NO: 733342 - DNA, 13 bp, C. elegans
ttcaaaatttcga

SEQ ID NO: 733343 - DNA, 14 bp, C. elegans
ttcaaaatttctat

SEQ ID NO: 733344 - DNA, 13 bp, C. elegans
ttcaaaatttctg

SEQ ID NO: 733345 - DNA, 13 bp, C. elegans
ttcaaaatttgtg

SEQ ID NO: 733346 - DNA, 13 bp, C. elegans
ttcaaaattttca

SEQ ID NO: 733347 - DNA, 13 bp, C. elegans
ttcaaaattttcg

SEQ ID NO: 733348 - DNA, 13 bp, C. elegans
ttcaaaattttgc

SEQ ID NO: 733349 - DNA, 13 bp, C. elegans
ttcaaaattttgt

SEQ ID NO: 733350 - DNA, 13 bp, C. elegans
ttcaaaatttttc

SEQ ID NO: 733351 - DNA, 13 bp, C. elegans
ttcaaacaaaatg

SEQ ID NO: 733352 - DNA, 13 bp, C. elegans
ttcaaacaacatt

SEQ ID NO: 733353 - DNA, 13 bp, C. elegans
ttcaaacaactat

SEQ ID NO: 733354 - DNA, 13 bp, C. elegans
ttcaaacaacttt

SEQ ID NO: 733355 - DNA, 13 bp, C. elegans
ttcaaacaataca

SEQ ID NO: 733356 - DNA, 13 bp, C. elegans
ttcaaacaatatt

SEQ ID NO: 733357 - DNA, 13 bp, C. elegans
ttcaaacaatcaa

SEQ ID NO: 733358 - DNA, 13 bp, C. elegans
ttcaaacaattac

SEQ ID NO: 733359 - DNA, 13 bp, C. elegans
ttcaaacaattca

SEQ ID NO: 733360 - DNA, 13 bp, C. elegans
ttcaaacaattgt

SEQ ID NO: 733361 - DNA, 13 bp, C. elegans
ttcaaacagtttc

SEQ ID NO: 733362 - DNA, 13 bp, C. elegans
ttcaaacataaat

SEQ ID NO: 733363 - DNA, 13 bp, C. elegans
ttcaaacatcaca

SEQ ID NO: 733364 - DNA, 13 bp, C. elegans
ttcaaacatcatt

SEQ ID NO: 733365 - DNA, 13 bp, C. elegans
ttcaaacatcgaa

SEQ ID NO: 733366 - DNA, 13 bp, C. elegans
ttcaaacatctga

SEQ ID NO: 733367 - DNA, 13 bp, C. elegans
ttcaaacatgaaa

SEQ ID NO: 733368 - DNA, 13 bp, C. elegans
ttcaaacatgcaa

SEQ ID NO: 733369 - DNA, 13 bp, C. elegans
ttcaaacattcca

SEQ ID NO: 733370 - DNA, 13 bp, C. elegans
ttcaaacattcta

SEQ ID NO: 733371 - DNA, 13 bp, C. elegans
ttcaaacattctc

SEQ ID NO: 733372 - DNA, 13 bp, C. elegans
ttcaaacattctg

SEQ ID NO: 733373 - DNA, 13 bp, C. elegans
ttcaaacattgaa

SEQ ID NO: 733374 - DNA, 13 bp, C. elegans
ttcaaacattgat

SEQ ID NO: 733375 - DNA, 13 bp, C. elegans
ttcaaacatttca

SEQ ID NO: 733376 - DNA, 13 bp, C. elegans
ttcaaacatttcg

SEQ ID NO: 733377 - DNA, 13 bp, C. elegans
ttcaaacatttgg

SEQ ID NO: 733378 - DNA, 13 bp, C. elegans
ttcaaacatttgt

SEQ ID NO: 733379 - DNA, 13 bp, C. elegans
ttcaaacattttg

SEQ ID NO: 733380 - DNA, 13 bp, C. elegans
ttcaaacattttt

SEQ ID NO: 733381 - DNA, 13 bp, C. elegans
ttcaaaccaatca

SEQ ID NO: 733382 - DNA, 13 bp, C. elegans
ttcaaaccaattt

SEQ ID NO: 733383 - DNA, 13 bp, C. elegans
ttcaaaccatcaa

SEQ ID NO: 733384 - DNA, 13 bp, C. elegans
ttcaaaccatttc

SEQ ID NO: 733385 - DNA, 13 bp, C. elegans
ttcaaaccgaaaa

SEQ ID NO: 733386 - DNA, 13 bp, C. elegans
ttcaaacctgaaa

SEQ ID NO: 733387 - DNA, 13 bp, C. elegans
ttcaaaccttcaa

SEQ ID NO: 733388 - DNA, 13 bp, C. elegans
ttcaaaccttttc

SEQ ID NO: 733389 - DNA, 13 bp, C. elegans
ttcaaacgaaaat

SEQ ID NO: 733390 - DNA, 13 bp, C. elegans
ttcaaacgagcac

SEQ ID NO: 733391 - DNA, 13 bp, C. elegans
ttcaaacgttttc

SEQ ID NO: 733392 - DNA, 13 bp, C. elegans
ttcaaactaaaat

SEQ ID NO: 733393 - DNA, 13 bp, C. elegans
ttcaaactacaaa

SEQ ID NO: 733394 - DNA, 13 bp, C. elegans
ttcaaactacata

SEQ ID NO: 733395 - DNA, 13 bp, C. elegans
ttcaaactatcat

SEQ ID NO: 733396 - DNA, 13 bp, C. elegans
ttcaaactcatgt

SEQ ID NO: 733397 - DNA, 13 bp, C. elegans
ttcaaactctcaa

SEQ ID NO: 733398 - DNA, 13 bp, C. elegans
ttcaaactctcat

SEQ ID NO: 733399 - DNA, 13 bp, C. elegans
ttcaaactctttt

SEQ ID NO: 733400 - DNA, 13 bp, C. elegans
ttcaaactgaact

SEQ ID NO: 733401 - DNA, 13 bp, C. elegans
ttcaaactgataa

SEQ ID NO: 733402 - DNA, 13 bp, C. elegans
ttcaaactgatta

SEQ ID NO: 733403 - DNA, 13 bp, C. elegans
ttcaaactgattt

SEQ ID NO: 733404 - DNA, 13 bp, C. elegans
ttcaaactgtttt

SEQ ID NO: 733405 - DNA, 13 bp, C. elegans
ttcaaacttgaaa

SEQ ID NO: 733406 - DNA, 13 bp, C. elegans
ttcaaacttgatg

SEQ ID NO: 733407 - DNA, 13 bp, C. elegans
ttcaaacttgggc

SEQ ID NO: 733408 - DNA, 13 bp, C. elegans
ttcaaactttaaa

SEQ ID NO: 733409 - DNA, 13 bp, C. elegans
ttcaaactttaac

SEQ ID NO: 733410 - DNA, 13 bp, C. elegans
ttcaaactttaat

SEQ ID NO: 733411 - DNA, 13 bp, C. elegans
ttcaaactttcaa

SEQ ID NO: 733412 - DNA, 13 bp, C. elegans
ttcaaactttgag

SEQ ID NO: 733413 - DNA, 13 bp, C. elegans
ttcaaacttttat

SEQ ID NO: 733414 - DNA, 13 bp, C. elegans
ttcaaacttttca

SEQ ID NO: 733415 - DNA, 13 bp, C. elegans
ttcaaacttttcg

SEQ ID NO: 733416 - DNA, 13 bp, C. elegans
ttcaaacttttgt

SEQ ID NO: 733417 - DNA, 13 bp, C. elegans
ttcaaagaaaatg

SEQ ID NO: 733418 - DNA, 13 bp, C. elegans
ttcaaagaaacat

SEQ ID NO: 733419 - DNA, 13 bp, C. elegans
ttcaaagaaatga

SEQ ID NO: 733420 - DNA, 13 bp, C. elegans
ttcaaagaaattc

SEQ ID NO: 733421 - DNA, 13 bp, C. elegans
ttcaaagaaattg

SEQ ID NO: 733422 - DNA, 13 bp, C. elegans
ttcaaagaatatt

SEQ ID NO: 733423 - DNA, 15 bp, C. elegans
ttcaaagaatgctct

SEQ ID NO: 733424 - DNA, 13 bp, C. elegans
ttcaaagaccaaa

SEQ ID NO: 733425 - DNA, 13 bp, C. elegans
ttcaaagacttct

SEQ ID NO: 733426 - DNA, 13 bp, C. elegans
ttcaaagagattt

SEQ ID NO: 733427 - DNA, 13 bp, C. elegans
ttcaaagagtttt

SEQ ID NO: 733428 - DNA, 13 bp, C. elegans
ttcaaagatatat

SEQ ID NO: 733429 - DNA, 13 bp, C. elegans
ttcaaagatcaaa

SEQ ID NO: 733430 - DNA, 13 bp, C. elegans
ttcaaagatcaga

SEQ ID NO: 733431 - DNA, 13 bp, C. elegans
ttcaaagatgaaa

SEQ ID NO: 733432 - DNA, 13 bp, C. elegans
ttcaaagattcaa

SEQ ID NO: 733433 - DNA, 13 bp, C. elegans
ttcaaagatttaa

SEQ ID NO: 733434 - DNA, 13 bp, C. elegans
ttcaaagatttag

SEQ ID NO: 733435 - DNA, 13 bp, C. elegans
ttcaaagatttcc

SEQ ID NO: 733436 - DNA, 13 bp, C. elegans
ttcaaagatttct

SEQ ID NO: 733437 - DNA, 13 bp, C. elegans
ttcaaagattttc

SEQ ID NO: 733438 - DNA, 13 bp, C. elegans
ttcaaagcatttc

SEQ ID NO: 733439 - DNA, 13 bp, C. elegans
ttcaaagcctttt

SEQ ID NO: 733440 - DNA, 13 bp, C. elegans
ttcaaagcgaaca

SEQ ID NO: 733441 - DNA, 13 bp, C. elegans
ttcaaagctttaa

SEQ ID NO: 733442 - DNA, 13 bp, C. elegans
ttcaaagctttca

SEQ ID NO: 733443 - DNA, 13 bp, C. elegans
ttcaaagcttttc

SEQ ID NO: 733444 - DNA, 13 bp, C. elegans
ttcaaaggaaatt

SEQ ID NO: 733445 - DNA, 13 bp, C. elegans
ttcaaaggaattt

SEQ ID NO: 733446 - DNA, 13 bp, C. elegans
ttcaaaggttctt

SEQ ID NO: 733447 - DNA, 13 bp, C. elegans
ttcaaaggtttca

SEQ ID NO: 733448 - DNA, 13 bp, C. elegans
ttcaaagtaaatt

SEQ ID NO: 733449 - DNA, 15 bp, C. elegans
ttcaaagtaactttt

SEQ ID NO: 733450 - DNA, 13 bp, C. elegans
ttcaaagtattca

SEQ ID NO: 733451 - DNA, 13 bp, C. elegans
ttcaaagtattga

SEQ ID NO: 733452 - DNA, 13 bp, C. elegans
ttcaaagtattta

SEQ ID NO: 733453 - DNA, 13 bp, C. elegans
ttcaaagtcctga

SEQ ID NO: 733454 - DNA, 13 bp, C. elegans
ttcaaagtgagaa

SEQ ID NO: 733455 - DNA, 13 bp, C. elegans
ttcaaagtgttca

SEQ ID NO: 733456 - DNA, 13 bp, C. elegans
ttcaaagttattc

SEQ ID NO: 733457 - DNA, 13 bp, C. elegans
ttcaaagttcaag

SEQ ID NO: 733458 - DNA, 13 bp, C. elegans
ttcaaagttcgaa

SEQ ID NO: 733459 - DNA, 13 bp, C. elegans
ttcaaagttgcaa

SEQ ID NO: 733460 - DNA, 13 bp, C. elegans
ttcaaagtttcaa

SEQ ID NO: 733461 - DNA, 13 bp, C. elegans
ttcaaagtttctt

SEQ ID NO: 733462 - DNA, 13 bp, C. elegans
ttcaaagtttgaa

SEQ ID NO: 733463 - DNA, 14 bp, C. elegans
ttcaaagtttggaa

SEQ ID NO: 733464 - DNA, 13 bp, C. elegans
ttcaaagtttggc

SEQ ID NO: 733465 - DNA, 13 bp, C. elegans
ttcaaagttttat

SEQ ID NO: 733466 - DNA, 13 bp, C. elegans
ttcaaagttttct

SEQ ID NO: 733467 - DNA, 13 bp, C. elegans
ttcaaagttttgt

SEQ ID NO: 733468 - DNA, 13 bp, C. elegans
ttcaaataaactc

SEQ ID NO: 733469 - DNA, 13 bp, C. elegans
ttcaaataaactt

SEQ ID NO: 733470 - DNA, 13 bp, C. elegans
ttcaaataaagca

SEQ ID NO: 733471 - DNA, 13 bp, C. elegans
ttcaaataagaaa

SEQ ID NO: 733472 - DNA, 13 bp, C. elegans
ttcaaataatcat

SEQ ID NO: 733473 - DNA, 13 bp, C. elegans
ttcaaataatcga

SEQ ID NO: 733474 - DNA, 13 bp, C. elegans
ttcaaataatctc

SEQ ID NO: 733475 - DNA, 13 bp, C. elegans
ttcaaataatgtt

SEQ ID NO: 733476 - DNA, 13 bp, C. elegans
ttcaaataattct

SEQ ID NO: 733477 - DNA, 13 bp, C. elegans
ttcaaatacttca

SEQ ID NO: 733478 - DNA, 13 bp, C. elegans
ttcaaatagaaat

SEQ ID NO: 733479 - DNA, 13 bp, C. elegans
ttcaaatagttat

SEQ ID NO: 733480 - DNA, 13 bp, C. elegans
ttcaaatagttca

SEQ ID NO: 733481 - DNA, 13 bp, C. elegans
ttcaaatagttta

SEQ ID NO: 733482 - DNA, 13 bp, C. elegans
ttcaaatatcaaa

SEQ ID NO: 733483 - DNA, 13 bp, C. elegans
ttcaaatatcgta

SEQ ID NO: 733484 - DNA, 13 bp, C. elegans
ttcaaatatctca

SEQ ID NO: 733485 - DNA, 13 bp, C. elegans
ttcaaatatctga

SEQ ID NO: 733486 - DNA, 13 bp, C. elegans
ttcaaatatcttc

SEQ ID NO: 733487 - DNA, 13 bp, C. elegans
ttcaaatattaga

SEQ ID NO: 733488 - DNA, 13 bp, C. elegans
ttcaaatattcag

SEQ ID NO: 733489 - DNA, 13 bp, C. elegans
ttcaaatattcgt

SEQ ID NO: 733490 - DNA, 13 bp, C. elegans
ttcaaatattgaa

SEQ ID NO: 733491 - DNA, 13 bp, C. elegans
ttcaaatattgag

SEQ ID NO: 733492 - DNA, 13 bp, C. elegans
ttcaaatattgta

SEQ ID NO: 733493 - DNA, 13 bp, C. elegans
ttcaaatattgtt

SEQ ID NO: 733494 - DNA, 13 bp, C. elegans
ttcaaatatttca

SEQ ID NO: 733495 - DNA, 13 bp, C. elegans
ttcaaatattttc

SEQ ID NO: 733496 - DNA, 13 bp, C. elegans
ttcaaatattttg

SEQ ID NO: 733497 - DNA, 13 bp, C. elegans
ttcaaatcaaaag

SEQ ID NO: 733498 - DNA, 13 bp, C. elegans
ttcaaatcaaatt

SEQ ID NO: 733499 - DNA, 13 bp, C. elegans
ttcaaatcaatta

SEQ ID NO: 733500 - DNA, 13 bp, C. elegans
ttcaaatcaattt

SEQ ID NO: 733501 - DNA, 13 bp, C. elegans
ttcaaatcacaaa

SEQ ID NO: 733502 - DNA, 13 bp, C. elegans
ttcaaatcagttt

SEQ ID NO: 733503 - DNA, 13 bp, C. elegans
ttcaaatcatcaa

SEQ ID NO: 733504 - DNA, 13 bp, C. elegans
ttcaaatcatcat

SEQ ID NO: 733505 - DNA, 13 bp, C. elegans
ttcaaatcattat

SEQ ID NO: 733506 - DNA, 13 bp, C. elegans
ttcaaatcattca

SEQ ID NO: 733507 - DNA, 13 bp, C. elegans
ttcaaatcattta

SEQ ID NO: 733508 - DNA, 13 bp, C. elegans
ttcaaatccaaaa

SEQ ID NO: 733509 - DNA, 13 bp, C. elegans
ttcaaatcggaaa

SEQ ID NO: 733510 - DNA, 13 bp, C. elegans
ttcaaatcggaat

SEQ ID NO: 733511 - DNA, 13 bp, C. elegans
ttcaaatctaaaa

SEQ ID NO: 733512 - DNA, 13 bp, C. elegans
ttcaaatctcaaa

SEQ ID NO: 733513 - DNA, 13 bp, C. elegans
ttcaaatcttcaa

SEQ ID NO: 733514 - DNA, 13 bp, C. elegans
ttcaaatcttgaa

SEQ ID NO: 733515 - DNA, 13 bp, C. elegans
ttcaaatctttca

SEQ ID NO: 733516 - DNA, 13 bp, C. elegans
ttcaaatctttct

SEQ ID NO: 733517 - DNA, 13 bp, C. elegans
ttcaaatctttta

SEQ ID NO: 733518 - DNA, 13 bp, C. elegans
ttcaaatgaaact

SEQ ID NO: 733519 - DNA, 13 bp, C. elegans
ttcaaatgaaatt

SEQ ID NO: 733520 - DNA, 13 bp, C. elegans
ttcaaatgaatat

SEQ ID NO: 733521 - DNA, 13 bp, C. elegans
ttcaaatgacata

SEQ ID NO: 733522 - DNA, 13 bp, C. elegans
ttcaaatgacccc

SEQ ID NO: 733523 - DNA, 13 bp, C. elegans
ttcaaatgagaat

SEQ ID NO: 733524 - DNA, 13 bp, C. elegans
ttcaaatgataaa

SEQ ID NO: 733525 - DNA, 13 bp, C. elegans
ttcaaatgatcat

SEQ ID NO: 733526 - DNA, 13 bp, C. elegans
ttcaaatgatgtt

SEQ ID NO: 733527 - DNA, 13 bp, C. elegans
ttcaaatgattaa

SEQ ID NO: 733528 - DNA, 13 bp, C. elegans
ttcaaatgatttt

SEQ ID NO: 733529 - DNA, 13 bp, C. elegans
ttcaaatgcaaat

SEQ ID NO: 733530 - DNA, 13 bp, C. elegans
ttcaaatgcgaaa

SEQ ID NO: 733531 - DNA, 13 bp, C. elegans
ttcaaatgctctt

SEQ ID NO: 733532 - DNA, 13 bp, C. elegans
ttcaaatgctttt

SEQ ID NO: 733533 - DNA, 13 bp, C. elegans
ttcaaatggcaaa

SEQ ID NO: 733534 - DNA, 13 bp, C. elegans
ttcaaatgggaat

SEQ ID NO: 733535 - DNA, 13 bp, C. elegans
ttcaaatgtaata

SEQ ID NO: 733536 - DNA, 13 bp, C. elegans
ttcaaatgtataa

SEQ ID NO: 733537 - DNA, 13 bp, C. elegans
ttcaaatgtatta

SEQ ID NO: 733538 - DNA, 13 bp, C. elegans
ttcaaatgtgtgt

SEQ ID NO: 733539 - DNA, 13 bp, C. elegans
ttcaaatgttcaa

SEQ ID NO: 733540 - DNA, 13 bp, C. elegans
ttcaaatgttcat

SEQ ID NO: 733541 - DNA, 13 bp, C. elegans
ttcaaatgttctt

SEQ ID NO: 733542 - DNA, 13 bp, C. elegans
ttcaaatgttgaa

SEQ ID NO: 733543 - DNA, 13 bp, C. elegans
ttcaaatgtttat

SEQ ID NO: 733544 - DNA, 13 bp, C. elegans
ttcaaatgtttct

SEQ ID NO: 733545 - DNA, 13 bp, C. elegans
ttcaaattaaaca

SEQ ID NO: 733546 - DNA, 13 bp, C. elegans
ttcaaattaagtt

SEQ ID NO: 733547 - DNA, 13 bp, C. elegans
ttcaaattacata

SEQ ID NO: 733548 - DNA, 13 bp, C. elegans
ttcaaattacatt

SEQ ID NO: 733549 - DNA, 13 bp, C. elegans
ttcaaattagaaa

SEQ ID NO: 733550 - DNA, 13 bp, C. elegans
ttcaaattatgaa

SEQ ID NO: 733551 - DNA, 13 bp, C. elegans
ttcaaattatgat

SEQ ID NO: 733552 - DNA, 13 bp, C. elegans
ttcaaattattgg

SEQ ID NO: 733553 - DNA, 13 bp, C. elegans
ttcaaattatttc

SEQ ID NO: 733554 - DNA, 13 bp, C. elegans
ttcaaattatttg

SEQ ID NO: 733555 - DNA, 13 bp, C. elegans
ttcaaattcaaat

SEQ ID NO: 733556 - DNA, 13 bp, C. elegans
ttcaaattcaagt

SEQ ID NO: 733557 - DNA, 13 bp, C. elegans
ttcaaattcaatt

SEQ ID NO: 733558 - DNA, 13 bp, C. elegans
ttcaaattcacaa

SEQ ID NO: 733559 - DNA, 13 bp, C. elegans
ttcaaattcataa

SEQ ID NO: 733560 - DNA, 13 bp, C. elegans
ttcaaattcattc

SEQ ID NO: 733561 - DNA, 13 bp, C. elegans
ttcaaattccaac

SEQ ID NO: 733562 - DNA, 13 bp, C. elegans
ttcaaattccaat

SEQ ID NO: 733563 - DNA, 13 bp, C. elegans
ttcaaattccagc

SEQ ID NO: 733564 - DNA, 13 bp, C. elegans
ttcaaattcctca

SEQ ID NO: 733565 - DNA, 13 bp, C. elegans
ttcaaattcctga

SEQ ID NO: 733566 - DNA, 13 bp, C. elegans
ttcaaattcgaaa

SEQ ID NO: 733567 - DNA, 13 bp, C. elegans
ttcaaattctaca

SEQ ID NO: 733568 - DNA, 13 bp, C. elegans
ttcaaattctagc

SEQ ID NO: 733569 - DNA, 13 bp, C. elegans
ttcaaattctcca

SEQ ID NO: 733570 - DNA, 13 bp, C. elegans
ttcaaattctcga

SEQ ID NO: 733571 - DNA, 13 bp, C. elegans
ttcaaattctcta

SEQ ID NO: 733572 - DNA, 13 bp, C. elegans
ttcaaattctctc

SEQ ID NO: 733573 - DNA, 13 bp, C. elegans
ttcaaattctctt

SEQ ID NO: 733574 - DNA, 13 bp, C. elegans
ttcaaattctgat

SEQ ID NO: 733575 - DNA, 13 bp, C. elegans
ttcaaattctgct

SEQ ID NO: 733576 - DNA, 13 bp, C. elegans
ttcaaattctgta

SEQ ID NO: 733577 - DNA, 13 bp, C. elegans
ttcaaattcttaa

SEQ ID NO: 733578 - DNA, 13 bp, C. elegans
ttcaaattcttca

SEQ ID NO: 733579 - DNA, 13 bp, C. elegans
ttcaaattgaaac

SEQ ID NO: 733580 - DNA, 13 bp, C. elegans
ttcaaattgaaat

SEQ ID NO: 733581 - DNA, 13 bp, C. elegans
ttcaaattgagca

SEQ ID NO: 733582 - DNA, 13 bp, C. elegans
ttcaaattgatct

SEQ ID NO: 733583 - DNA, 13 bp, C. elegans
ttcaaattgattc

SEQ ID NO: 733584 - DNA, 13 bp, C. elegans
ttcaaattgattt

SEQ ID NO: 733585 - DNA, 13 bp, C. elegans
ttcaaattgcaat

SEQ ID NO: 733586 - DNA, 13 bp, C. elegans
ttcaaattggaac

SEQ ID NO: 733587 - DNA, 13 bp, C. elegans
ttcaaattggaag

SEQ ID NO: 733588 - DNA, 13 bp, C. elegans
ttcaaattgttat

SEQ ID NO: 733589 - DNA, 13 bp, C. elegans
ttcaaattgttct

SEQ ID NO: 733590 - DNA, 13 bp, C. elegans
ttcaaattgttta

SEQ ID NO: 733591 - DNA, 13 bp, C. elegans
ttcaaattgtttg

SEQ ID NO: 733592 - DNA, 13 bp, C. elegans
ttcaaattgtttt

SEQ ID NO: 733593 - DNA, 13 bp, C. elegans
ttcaaatttaaca

SEQ ID NO: 733594 - DNA, 13 bp, C. elegans
ttcaaatttagtt

SEQ ID NO: 733595 - DNA, 13 bp, C. elegans
ttcaaatttatgt

SEQ ID NO: 733596 - DNA, 13 bp, C. elegans
ttcaaatttcaac

SEQ ID NO: 733597 - DNA, 13 bp, C. elegans
ttcaaatttcaca

SEQ ID NO: 733598 - DNA, 13 bp, C. elegans
ttcaaatttccac

SEQ ID NO: 733599 - DNA, 13 bp, C. elegans
ttcaaatttcccc

SEQ ID NO: 733600 - DNA, 15 bp, C. elegans
ttcaaatttcccgct

SEQ ID NO: 733601 - DNA, 13 bp, C. elegans
ttcaaatttcgcc

SEQ ID NO: 733602 - DNA, 13 bp, C. elegans
ttcaaatttctcg

SEQ ID NO: 733603 - DNA, 13 bp, C. elegans
ttcaaatttcttg

SEQ ID NO: 733604 - DNA, 13 bp, C. elegans
ttcaaatttggaa

SEQ ID NO: 733605 - DNA, 13 bp, C. elegans
ttcaaatttgtca

SEQ ID NO: 733606 - DNA, 13 bp, C. elegans
ttcaaattttaga

SEQ ID NO: 733607 - DNA, 13 bp, C. elegans
ttcaaattttatg

SEQ ID NO: 733608 - DNA, 13 bp, C. elegans
ttcaaattttcag

SEQ ID NO: 733609 - DNA, 13 bp, C. elegans
ttcaaattttcca

SEQ ID NO: 733610 - DNA, 13 bp, C. elegans
ttcaaattttccg

SEQ ID NO: 733611 - DNA, 13 bp, C. elegans
ttcaaattttcga

SEQ ID NO: 733612 - DNA, 13 bp, C. elegans
ttcaaattttcgc

SEQ ID NO: 733613 - DNA, 14 bp, C. elegans
ttcaaattttctat

SEQ ID NO: 733614 - DNA, 13 bp, C. elegans
ttcaaattttctc

SEQ ID NO: 733615 - DNA, 14 bp, C. elegans
ttcaaattttctgt

SEQ ID NO: 733616 - DNA, 13 bp, C. elegans
ttcaaattttgac

SEQ ID NO: 733617 - DNA, 14 bp, C. elegans
ttcaaattttgttt

SEQ ID NO: 733618 - DNA, 13 bp, C. elegans
ttcaaatttttag

SEQ ID NO: 733619 - DNA, 13 bp, C. elegans
ttcaaatttttca

SEQ ID NO: 733620 - DNA, 13 bp, C. elegans
ttcaaatttttcg

SEQ ID NO: 733621 - DNA, 13 bp, C. elegans
ttcaaatttttgc

SEQ ID NO: 733622 - DNA, 13 bp, C. elegans
ttcaaatttttgt

SEQ ID NO: 733623 - DNA, 13 bp, C. elegans
ttcaacaaaaaag

SEQ ID NO: 733624 - DNA, 13 bp, C. elegans
ttcaacaaaaaga

SEQ ID NO: 733625 - DNA, 13 bp, C. elegans
ttcaacaaaaatc

SEQ ID NO: 733626 - DNA, 13 bp, C. elegans
ttcaacaaaaatg

SEQ ID NO: 733627 - DNA, 13 bp, C. elegans
ttcaacaaaacca

SEQ ID NO: 733628 - DNA, 13 bp, C. elegans
ttcaacaaaatct

SEQ ID NO: 733629 - DNA, 13 bp, C. elegans
ttcaacaaaatgt

SEQ ID NO: 733630 - DNA, 13 bp, C. elegans
ttcaacaaacaat

SEQ ID NO: 733631 - DNA, 13 bp, C. elegans
ttcaacaaacatt

SEQ ID NO: 733632 - DNA, 13 bp, C. elegans
ttcaacaaacttt

SEQ ID NO: 733633 - DNA, 13 bp, C. elegans
ttcaacaaataat

SEQ ID NO: 733634 - DNA, 13 bp, C. elegans
ttcaacaaatatt

SEQ ID NO: 733635 - DNA, 13 bp, C. elegans
ttcaacaaatcaa

SEQ ID NO: 733636 - DNA, 13 bp, C. elegans
ttcaacaaatctt

SEQ ID NO: 733637 - DNA, 13 bp, C. elegans
ttcaacaaatgtt

SEQ ID NO: 733638 - DNA, 13 bp, C. elegans
ttcaacaaattat

SEQ ID NO: 733639 - DNA, 13 bp, C. elegans
ttcaacaaattga

SEQ ID NO: 733640 - DNA, 13 bp, C. elegans
ttcaacaaattta

SEQ ID NO: 733641 - DNA, 13 bp, C. elegans
ttcaacaaatttc

SEQ ID NO: 733642 - DNA, 13 bp, C. elegans
ttcaacaaatttt

SEQ ID NO: 733643 - DNA, 13 bp, C. elegans
ttcaacaacttca

SEQ ID NO: 733644 - DNA, 13 bp, C. elegans
ttcaacaactttg

SEQ ID NO: 733645 - DNA, 13 bp, C. elegans
ttcaacaactttt

SEQ ID NO: 733646 - DNA, 13 bp, C. elegans
ttcaacaagaaat

SEQ ID NO: 733647 - DNA, 13 bp, C. elegans
ttcaacaatattt

SEQ ID NO: 733648 - DNA, 13 bp, C. elegans
ttcaacaatgttt

SEQ ID NO: 733649 - DNA, 13 bp, C. elegans
ttcaacaattata

SEQ ID NO: 733650 - DNA, 13 bp, C. elegans
ttcaacaattcca

SEQ ID NO: 733651 - DNA, 13 bp, C. elegans
ttcaacaattcta

SEQ ID NO: 733652 - DNA, 13 bp, C. elegans
ttcaacaattgaa

SEQ ID NO: 733653 - DNA, 13 bp, C. elegans
ttcaacaattgcc

SEQ ID NO: 733654 - DNA, 13 bp, C. elegans
ttcaacaattgtt

SEQ ID NO: 733655 - DNA, 13 bp, C. elegans
ttcaacaatttcc

SEQ ID NO: 733656 - DNA, 13 bp, C. elegans
ttcaacaatttcg

SEQ ID NO: 733657 - DNA, 13 bp, C. elegans
ttcaacaatttta

SEQ ID NO: 733658 - DNA, 13 bp, C. elegans
ttcaacaattttc

SEQ ID NO: 733659 - DNA, 13 bp, C. elegans
ttcaacaattttg

SEQ ID NO: 733660 - DNA, 13 bp, C. elegans
ttcaacaattttt

SEQ ID NO: 733661 - DNA, 13 bp, C. elegans
ttcaacacaaatt

SEQ ID NO: 733662 - DNA, 13 bp, C. elegans
ttcaacacacttt

SEQ ID NO: 733663 - DNA, 13 bp, C. elegans
ttcaacactattt

SEQ ID NO: 733664 - DNA, 13 bp, C. elegans
ttcaacagaaata

SEQ ID NO: 733665 - DNA, 13 bp, C. elegans
ttcaacaggaaaa

SEQ ID NO: 733666 - DNA, 13 bp, C. elegans
ttcaacaggaaat

SEQ ID NO: 733667 - DNA, 13 bp, C. elegans
ttcaacagtttta

SEQ ID NO: 733668 - DNA, 13 bp, C. elegans
ttcaacataaaat

SEQ ID NO: 733669 - DNA, 13 bp, C. elegans
ttcaacatgtttt

SEQ ID NO: 733670 - DNA, 13 bp, C. elegans
ttcaacattaatt

SEQ ID NO: 733671 - DNA, 13 bp, C. elegans
ttcaacattattc

SEQ ID NO: 733672 - DNA, 13 bp, C. elegans
ttcaacattgaaa

SEQ ID NO: 733673 - DNA, 13 bp, C. elegans
ttcaacatttaca

SEQ ID NO: 733674 - DNA, 13 bp, C. elegans
ttcaacatttcag

SEQ ID NO: 733675 - DNA, 13 bp, C. elegans
ttcaacatttctt

SEQ ID NO: 733676 - DNA, 13 bp, C. elegans
ttcaacatttgct

SEQ ID NO: 733677 - DNA, 13 bp, C. elegans
ttcaaccaaaata

SEQ ID NO: 733678 - DNA, 13 bp, C. elegans
ttcaaccaaattt

SEQ ID NO: 733679 - DNA, 13 bp, C. elegans
ttcaaccaacaaa

SEQ ID NO: 733680 - DNA, 13 bp, C. elegans
ttcaaccaatcaa

SEQ ID NO: 733681 - DNA, 13 bp, C. elegans
ttcaaccaatttt

SEQ ID NO: 733682 - DNA, 13 bp, C. elegans
ttcaaccagtttt

SEQ ID NO: 733683 - DNA, 13 bp, C. elegans
ttcaacccaaaat

SEQ ID NO: 733684 - DNA, 13 bp, C. elegans
ttcaaccgttttt

SEQ ID NO: 733685 - DNA, 13 bp, C. elegans
ttcaacctgaaaa

SEQ ID NO: 733686 - DNA, 13 bp, C. elegans
ttcaaccttcaaa

SEQ ID NO: 733687 - DNA, 13 bp, C. elegans
ttcaacgaaaaaa

SEQ ID NO: 733688 - DNA, 13 bp, C. elegans
ttcaacgaaaaat

SEQ ID NO: 733689 - DNA, 13 bp, C. elegans
ttcaacgaaaagt

SEQ ID NO: 733690 - DNA, 13 bp, C. elegans
ttcaacgagaaaa

SEQ ID NO: 733691 - DNA, 13 bp, C. elegans
ttcaacgaggaag

SEQ ID NO: 733692 - DNA, 13 bp, C. elegans
ttcaacgatttta

SEQ ID NO: 733693 - DNA, 13 bp, C. elegans
ttcaacgattttt

SEQ ID NO: 733694 - DNA, 13 bp, C. elegans
ttcaacgcttttt

SEQ ID NO: 733695 - DNA, 13 bp, C. elegans
ttcaacggaaaaa

SEQ ID NO: 733696 - DNA, 13 bp, C. elegans
ttcaacgtcgtcg

SEQ ID NO: 733697 - DNA, 13 bp, C. elegans
ttcaacgtgaaag

SEQ ID NO: 733698 - DNA, 13 bp, C. elegans
ttcaactaaatat

SEQ ID NO: 733699 - DNA, 13 bp, C. elegans
ttcaactacaaaa

SEQ ID NO: 733700 - DNA, 13 bp, C. elegans
ttcaactacagta

SEQ ID NO: 733701 - DNA, 13 bp, C. elegans
ttcaactacgaaa

SEQ ID NO: 733702 - DNA, 13 bp, C. elegans
ttcaactattatt

SEQ ID NO: 733703 - DNA, 13 bp, C. elegans
ttcaactattcaa

SEQ ID NO: 733704 - DNA, 13 bp, C. elegans
ttcaactatttca

SEQ ID NO: 733705 - DNA, 13 bp, C. elegans
ttcaactcaaatt

SEQ ID NO: 733706 - DNA, 13 bp, C. elegans
ttcaactcaatgt

SEQ ID NO: 733707 - DNA, 13 bp, C. elegans
ttcaactccaaaa

SEQ ID NO: 733708 - DNA, 13 bp, C. elegans
ttcaactctccaa

SEQ ID NO: 733709 - DNA, 18 bp, C. elegans
ttcaactctccaccacgg

SEQ ID NO: 733710 - DNA, 13 bp, C. elegans
ttcaactgaaaat

SEQ ID NO: 733711 - DNA, 13 bp, C. elegans
ttcaactgaaatt

SEQ ID NO: 733712 - DNA, 13 bp, C. elegans
ttcaactgacaaa

SEQ ID NO: 733713 - DNA, 13 bp, C. elegans
ttcaactggaaat

SEQ ID NO: 733714 - DNA, 13 bp, C. elegans
ttcaactgtaaaa

SEQ ID NO: 733715 - DNA, 13 bp, C. elegans
ttcaacttcaaca

SEQ ID NO: 733716 - DNA, 13 bp, C. elegans
ttcaacttcaata

SEQ ID NO: 733717 - DNA, 13 bp, C. elegans
ttcaacttcaatt

SEQ ID NO: 733718 - DNA, 13 bp, C. elegans
ttcaacttccaaa

SEQ ID NO: 733719 - DNA, 13 bp, C. elegans
ttcaacttctcaa

SEQ ID NO: 733720 - DNA, 13 bp, C. elegans
ttcaacttcttaa

SEQ ID NO: 733721 - DNA, 13 bp, C. elegans
ttcaacttcttct

SEQ ID NO: 733722 - DNA, 13 bp, C. elegans
ttcaacttgaaac

SEQ ID NO: 733723 - DNA, 13 bp, C. elegans
ttcaacttgaaat

SEQ ID NO: 733724 - DNA, 13 bp, C. elegans
ttcaacttgtttt

SEQ ID NO: 733725 - DNA, 13 bp, C. elegans
ttcaactttaaat

SEQ ID NO: 733726 - DNA, 13 bp, C. elegans
ttcaactttataa

SEQ ID NO: 733727 - DNA, 13 bp, C. elegans
ttcaactttgaca

SEQ ID NO: 733728 - DNA, 13 bp, C. elegans
ttcaactttgagc

SEQ ID NO: 733729 - DNA, 13 bp, C. elegans
ttcaactttggaa

SEQ ID NO: 733730 - DNA, 13 bp, C. elegans
ttcaactttggca

SEQ ID NO: 733731 - DNA, 13 bp, C. elegans
ttcaacttttaaa

SEQ ID NO: 733732 - DNA, 13 bp, C. elegans
ttcaacttttcaa

SEQ ID NO: 733733 - DNA, 13 bp, C. elegans
ttcaacttttcag

SEQ ID NO: 733734 - DNA, 13 bp, C. elegans
ttcaacttttcca

SEQ ID NO: 733735 - DNA, 13 bp, C. elegans
ttcaacttttcga

SEQ ID NO: 733736 - DNA, 13 bp, C. elegans
ttcaacttttcgt

SEQ ID NO: 733737 - DNA, 13 bp, C. elegans
ttcaacttttgaa

SEQ ID NO: 733738 - DNA, 13 bp, C. elegans
ttcaacttttgca

SEQ ID NO: 733739 - DNA, 13 bp, C. elegans
ttcaacttttggt

SEQ ID NO: 733740 - DNA, 13 bp, C. elegans
ttcaactttttcc

SEQ ID NO: 733741 - DNA, 13 bp, C. elegans
ttcaactttttgt

SEQ ID NO: 733742 - DNA, 13 bp, C. elegans
ttcaagaaaaaat

SEQ ID NO: 733743 - DNA, 13 bp, C. elegans
ttcaagaaaaata

SEQ ID NO: 733744 - DNA, 13 bp, C. elegans
ttcaagaaaaatc

SEQ ID NO: 733745 - DNA, 13 bp, C. elegans
ttcaagaaaaatg

SEQ ID NO: 733746 - DNA, 14 bp, C. elegans
ttcaagaaaaattg

SEQ ID NO: 733747 - DNA, 13 bp, C. elegans
ttcaagaaaacca

SEQ ID NO: 733748 - DNA, 13 bp, C. elegans
ttcaagaaaagaa

SEQ ID NO: 733749 - DNA, 13 bp, C. elegans
ttcaagaaaatgc

SEQ ID NO: 733750 - DNA, 13 bp, C. elegans
ttcaagaaataaa

SEQ ID NO: 733751 - DNA, 13 bp, C. elegans
ttcaagaaatatt

SEQ ID NO: 733752 - DNA, 13 bp, C. elegans
ttcaagaaatgaa

SEQ ID NO: 733753 - DNA, 13 bp, C. elegans
ttcaagaaatgat

SEQ ID NO: 733754 - DNA, 13 bp, C. elegans
ttcaagaaattgg

SEQ ID NO: 733755 - DNA, 13 bp, C. elegans
ttcaagaaatttt

SEQ ID NO: 733756 - DNA, 13 bp, C. elegans
ttcaagaacattt

SEQ ID NO: 733757 - DNA, 13 bp, C. elegans
ttcaagaactgaa

SEQ ID NO: 733758 - DNA, 13 bp, C. elegans
ttcaagaactttt

SEQ ID NO: 733759 - DNA, 13 bp, C. elegans
ttcaagaagaaat

SEQ ID NO: 733760 - DNA, 13 bp, C. elegans
ttcaagaagcttg

SEQ ID NO: 733761 - DNA, 13 bp, C. elegans
ttcaagaagtttc

SEQ ID NO: 733762 - DNA, 13 bp, C. elegans
ttcaagaatcaaa

SEQ ID NO: 733763 - DNA, 13 bp, C. elegans
ttcaagaattaat

SEQ ID NO: 733764 - DNA, 13 bp, C. elegans
ttcaagaattact

SEQ ID NO: 733765 - DNA, 13 bp, C. elegans
ttcaagaattcag

SEQ ID NO: 733766 - DNA, 13 bp, C. elegans
ttcaagaattgtt

SEQ ID NO: 733767 - DNA, 13 bp, C. elegans
ttcaagaatttaa

SEQ ID NO: 733768 - DNA, 13 bp, C. elegans
ttcaagaattttt

SEQ ID NO: 733769 - DNA, 13 bp, C. elegans
ttcaagacaaaaa

SEQ ID NO: 733770 - DNA, 13 bp, C. elegans
ttcaagacaattt

SEQ ID NO: 733771 - DNA, 13 bp, C. elegans
ttcaagagaaaag

SEQ ID NO: 733772 - DNA, 13 bp, C. elegans
ttcaagagaaaat

SEQ ID NO: 733773 - DNA, 13 bp, C. elegans
ttcaagagatttt

SEQ ID NO: 733774 - DNA, 13 bp, C. elegans
ttcaagagtattc

SEQ ID NO: 733775 - DNA, 13 bp, C. elegans
ttcaagagttttc

SEQ ID NO: 733776 - DNA, 13 bp, C. elegans
ttcaagagttttt

SEQ ID NO: 733777 - DNA, 13 bp, C. elegans
ttcaagatattct

SEQ ID NO: 733778 - DNA, 13 bp, C. elegans
ttcaagatatttt

SEQ ID NO: 733779 - DNA, 13 bp, C. elegans
ttcaagatgaaat

SEQ ID NO: 733780 - DNA, 13 bp, C. elegans
ttcaagattcaag

SEQ ID NO: 733781 - DNA, 13 bp, C. elegans
ttcaagatttatt

SEQ ID NO: 733782 - DNA, 13 bp, C. elegans
ttcaagatttcaa

SEQ ID NO: 733783 - DNA, 13 bp, C. elegans
ttcaagatttctt

SEQ ID NO: 733784 - DNA, 13 bp, C. elegans
ttcaagattttca

SEQ ID NO: 733785 - DNA, 13 bp, C. elegans
ttcaagatttttt

SEQ ID NO: 733786 - DNA, 13 bp, C. elegans
ttcaagcaaaagt

SEQ ID NO: 733787 - DNA, 13 bp, C. elegans
ttcaagcaacaaa

SEQ ID NO: 733788 - DNA, 13 bp, C. elegans
ttcaagcccaaaa

SEQ ID NO: 733789 - DNA, 13 bp, C. elegans
ttcaagccgaaaa

SEQ ID NO: 733790 - DNA, 13 bp, C. elegans
ttcaagcgaaaat

SEQ ID NO: 733791 - DNA, 13 bp, C. elegans
ttcaagcgttttt

SEQ ID NO: 733792 - DNA, 13 bp, C. elegans
ttcaagctatttc

SEQ ID NO: 733793 - DNA, 13 bp, C. elegans
ttcaagctcaaaa

SEQ ID NO: 733794 - DNA, 13 bp, C. elegans
ttcaagctcaaat

SEQ ID NO: 733795 - DNA, 13 bp, C. elegans
ttcaagctgattt

SEQ ID NO: 733796 - DNA, 13 bp, C. elegans
ttcaagcttaaaa

SEQ ID NO: 733797 - DNA, 13 bp, C. elegans
ttcaagcttttca

SEQ ID NO: 733798 - DNA, 13 bp, C. elegans
ttcaagctttttt

SEQ ID NO: 733799 - DNA, 13 bp, C. elegans
ttcaaggaaaaaa

SEQ ID NO: 733800 - DNA, 13 bp, C. elegans
ttcaaggaaaatt

SEQ ID NO: 733801 - DNA, 13 bp, C. elegans
ttcaagtacattt

SEQ ID NO: 733802 - DNA, 13 bp, C. elegans
ttcaagtactttt

SEQ ID NO: 733803 - DNA, 13 bp, C. elegans
ttcaagtagtttt

SEQ ID NO: 733804 - DNA, 13 bp, C. elegans
ttcaagtataaaa

SEQ ID NO: 733805 - DNA, 13 bp, C. elegans
ttcaagtattcaa

SEQ ID NO: 733806 - DNA, 13 bp, C. elegans
ttcaagtattttc

SEQ ID NO: 733807 - DNA, 13 bp, C. elegans
ttcaagtcaaaaa

SEQ ID NO: 733808 - DNA, 13 bp, C. elegans
ttcaagtcaatat

SEQ ID NO: 733809 - DNA, 13 bp, C. elegans
ttcaagtcaattt

SEQ ID NO: 733810 - DNA, 13 bp, C. elegans
ttcaagtcgaaaa

SEQ ID NO: 733811 - DNA, 13 bp, C. elegans
ttcaagtcttgaa

SEQ ID NO: 733812 - DNA, 13 bp, C. elegans
ttcaagtcttttt

SEQ ID NO: 733813 - DNA, 13 bp, C. elegans
ttcaagtgaaaca

SEQ ID NO: 733814 - DNA, 13 bp, C. elegans
ttcaagtggaaaa

SEQ ID NO: 733815 - DNA, 13 bp, C. elegans
ttcaagtgtttcc

SEQ ID NO: 733816 - DNA, 13 bp, C. elegans
ttcaagttaaaaa

SEQ ID NO: 733817 - DNA, 13 bp, C. elegans
ttcaagttaaatt

SEQ ID NO: 733818 - DNA, 13 bp, C. elegans
ttcaagttataaa

SEQ ID NO: 733819 - DNA, 13 bp, C. elegans
ttcaagttatcaa

SEQ ID NO: 733820 - DNA, 13 bp, C. elegans
ttcaagttcaaag

SEQ ID NO: 733821 - DNA, 13 bp, C. elegans
ttcaagttccaaa

SEQ ID NO: 733822 - DNA, 13 bp, C. elegans
ttcaagttgaaaa

SEQ ID NO: 733823 - DNA, 13 bp, C. elegans
ttcaagttgaaac

SEQ ID NO: 733824 - DNA, 13 bp, C. elegans
ttcaagtttattt

SEQ ID NO: 733825 - DNA, 13 bp, C. elegans
ttcaagtttcaaa

SEQ ID NO: 733826 - DNA, 13 bp, C. elegans
ttcaagtttccaa

SEQ ID NO: 733827 - DNA, 13 bp, C. elegans
ttcaagtttgaaa

SEQ ID NO: 733828 - DNA, 13 bp, C. elegans
ttcaagttttaat

SEQ ID NO: 733829 - DNA, 13 bp, C. elegans
ttcaagttttagg

SEQ ID NO: 733830 - DNA, 13 bp, C. elegans
ttcaagttttcac

SEQ ID NO: 733831 - DNA, 13 bp, C. elegans
ttcaagttttccc

SEQ ID NO: 733832 - DNA, 13 bp, C. elegans
ttcaagttttcga

SEQ ID NO: 733833 - DNA, 13 bp, C. elegans
ttcaagttttctt

SEQ ID NO: 733834 - DNA, 13 bp, C. elegans
ttcaagtttttat

SEQ ID NO: 733835 - DNA, 13 bp, C. elegans
ttcaagtttttct

SEQ ID NO: 733836 - DNA, 13 bp, C. elegans
ttcaagtttttga

SEQ ID NO: 733837 - DNA, 13 bp, C. elegans
ttcaagtttttgg

SEQ ID NO: 733838 - DNA, 13 bp, C. elegans
ttcaagtttttgt

SEQ ID NO: 733839 - DNA, 13 bp, C. elegans
ttcaagtttttta

SEQ ID NO: 733840 - DNA, 13 bp, C. elegans
ttcaataaaaaag

SEQ ID NO: 733841 - DNA, 13 bp, C. elegans
ttcaataaaaacc

SEQ ID NO: 733842 - DNA, 13 bp, C. elegans
ttcaataaaaaga

SEQ ID NO: 733843 - DNA, 13 bp, C. elegans
ttcaataaaacat

SEQ ID NO: 733844 - DNA, 13 bp, C. elegans
ttcaataaaacca

SEQ ID NO: 733845 - DNA, 13 bp, C. elegans
ttcaataaaatca

SEQ ID NO: 733846 - DNA, 13 bp, C. elegans
ttcaataaaatcc

SEQ ID NO: 733847 - DNA, 13 bp, C. elegans
ttcaataaaatgt

SEQ ID NO: 733848 - DNA, 13 bp, C. elegans
ttcaataaacttc

SEQ ID NO: 733849 - DNA, 13 bp, C. elegans
ttcaataaatcaa

SEQ ID NO: 733850 - DNA, 13 bp, C. elegans
ttcaataaatctt

SEQ ID NO: 733851 - DNA, 13 bp, C. elegans
ttcaataaatgtt

SEQ ID NO: 733852 - DNA, 13 bp, C. elegans
ttcaataaattca

SEQ ID NO: 733853 - DNA, 13 bp, C. elegans
ttcaataaatttc

SEQ ID NO: 733854 - DNA, 13 bp, C. elegans
ttcaataacgttt

SEQ ID NO: 733855 - DNA, 13 bp, C. elegans
ttcaataagtttt

SEQ ID NO: 733856 - DNA, 13 bp, C. elegans
ttcaataatcaaa

SEQ ID NO: 733857 - DNA, 13 bp, C. elegans
ttcaataatgaaa

SEQ ID NO: 733858 - DNA, 13 bp, C. elegans
ttcaataatttct

SEQ ID NO: 733859 - DNA, 13 bp, C. elegans
ttcaatacaacaa

SEQ ID NO: 733860 - DNA, 13 bp, C. elegans
ttcaatacaattt

SEQ ID NO: 733861 - DNA, 13 bp, C. elegans
ttcaatacacttt

SEQ ID NO: 733862 - DNA, 13 bp, C. elegans
ttcaatacagttt

SEQ ID NO: 733863 - DNA, 13 bp, C. elegans
ttcaatacatttt

SEQ ID NO: 733864 - DNA, 13 bp, C. elegans
ttcaatactattt

SEQ ID NO: 733865 - DNA, 13 bp, C. elegans
ttcaatactttca

SEQ ID NO: 733866 - DNA, 13 bp, C. elegans
ttcaatacttttc

SEQ ID NO: 733867 - DNA, 13 bp, C. elegans
ttcaatacttttg

SEQ ID NO: 733868 - DNA, 13 bp, C. elegans
ttcaatagtttca

SEQ ID NO: 733869 - DNA, 13 bp, C. elegans
ttcaatagttttc

SEQ ID NO: 733870 - DNA, 13 bp, C. elegans
ttcaatataaaac

SEQ ID NO: 733871 - DNA, 13 bp, C. elegans
ttcaatatatcaa

SEQ ID NO: 733872 - DNA, 13 bp, C. elegans
ttcaatatatgaa

SEQ ID NO: 733873 - DNA, 13 bp, C. elegans
ttcaatatcaaaa

SEQ ID NO: 733874 - DNA, 13 bp, C. elegans
ttcaatatcttca

SEQ ID NO: 733875 - DNA, 13 bp, C. elegans
ttcaatatgaaaa

SEQ ID NO: 733876 - DNA, 13 bp, C. elegans
ttcaatatgataa

SEQ ID NO: 733877 - DNA, 13 bp, C. elegans
ttcaatatgattt

SEQ ID NO: 733878 - DNA, 13 bp, C. elegans
ttcaatatgttca

SEQ ID NO: 733879 - DNA, 13 bp, C. elegans
ttcaatattacaa

SEQ ID NO: 733880 - DNA, 13 bp, C. elegans
ttcaatattattg

SEQ ID NO: 733881 - DNA, 13 bp, C. elegans
ttcaatattcaaa

SEQ ID NO: 733882 - DNA, 13 bp, C. elegans
ttcaatattcaat

SEQ ID NO: 733883 - DNA, 13 bp, C. elegans
ttcaatattcata

SEQ ID NO: 733884 - DNA, 13 bp, C. elegans
ttcaatattcctt

SEQ ID NO: 733885 - DNA, 13 bp, C. elegans
ttcaatattctaa

SEQ ID NO: 733886 - DNA, 13 bp, C. elegans
ttcaatattgttt

SEQ ID NO: 733887 - DNA, 13 bp, C. elegans
ttcaatatttcag

SEQ ID NO: 733888 - DNA, 13 bp, C. elegans
ttcaatatttgaa

SEQ ID NO: 733889 - DNA, 13 bp, C. elegans
ttcaatatttgtg

SEQ ID NO: 733890 - DNA, 13 bp, C. elegans
ttcaatattttca

SEQ ID NO: 733891 - DNA, 13 bp, C. elegans
ttcaatattttgc

SEQ ID NO: 733892 - DNA, 13 bp, C. elegans
ttcaatcaaaaat

SEQ ID NO: 733893 - DNA, 13 bp, C. elegans
ttcaatcaaaaca

SEQ ID NO: 733894 - DNA, 13 bp, C. elegans
ttcaatcaaaatc

SEQ ID NO: 733895 - DNA, 13 bp, C. elegans
ttcaatcaaataa

SEQ ID NO: 733896 - DNA, 13 bp, C. elegans
ttcaatcaaatta

SEQ ID NO: 733897 - DNA, 13 bp, C. elegans
ttcaatcaaattg

SEQ ID NO: 733898 - DNA, 13 bp, C. elegans
ttcaatcaacttt

SEQ ID NO: 733899 - DNA, 13 bp, C. elegans
ttcaatcaataca

SEQ ID NO: 733900 - DNA, 13 bp, C. elegans
ttcaatcaatatt

SEQ ID NO: 733901 - DNA, 13 bp, C. elegans
ttcaatcaatcaa

SEQ ID NO: 733902 - DNA, 13 bp, C. elegans
ttcaatcaattct

SEQ ID NO: 733903 - DNA, 13 bp, C. elegans
ttcaatcaatttt

SEQ ID NO: 733904 - DNA, 13 bp, C. elegans
ttcaatcacaaat

SEQ ID NO: 733905 - DNA, 13 bp, C. elegans
ttcaatcagaaaa

SEQ ID NO: 733906 - DNA, 13 bp, C. elegans
ttcaatcagaaat

SEQ ID NO: 733907 - DNA, 13 bp, C. elegans
ttcaatcagtttt

SEQ ID NO: 733908 - DNA, 13 bp, C. elegans
ttcaatcatattt

SEQ ID NO: 733909 - DNA, 13 bp, C. elegans
ttcaatcatttca

SEQ ID NO: 733910 - DNA, 13 bp, C. elegans
ttcaatcatttta

SEQ ID NO: 733911 - DNA, 13 bp, C. elegans
ttcaatcattttg

SEQ ID NO: 733912 - DNA, 13 bp, C. elegans
ttcaatcgaaatt

SEQ ID NO: 733913 - DNA, 13 bp, C. elegans
ttcaatcgatttc

SEQ ID NO: 733914 - DNA, 13 bp, C. elegans
ttcaatcgatttt

SEQ ID NO: 733915 - DNA, 13 bp, C. elegans
ttcaatctcaaaa

SEQ ID NO: 733916 - DNA, 13 bp, C. elegans
ttcaatctgattt

SEQ ID NO: 733917 - DNA, 13 bp, C. elegans
ttcaatctgtttt

SEQ ID NO: 733918 - DNA, 13 bp, C. elegans
ttcaatcttaaaa

SEQ ID NO: 733919 - DNA, 13 bp, C. elegans
ttcaatcttcaaa

SEQ ID NO: 733920 - DNA, 13 bp, C. elegans
ttcaatcttccaa

SEQ ID NO: 733921 - DNA, 13 bp, C. elegans
ttcaatctttgaa

SEQ ID NO: 733922 - DNA, 13 bp, C. elegans
ttcaatgaaaaca

SEQ ID NO: 733923 - DNA, 13 bp, C. elegans
ttcaatgaaaatt

SEQ ID NO: 733924 - DNA, 13 bp, C. elegans
ttcaatgaatatt

SEQ ID NO: 733925 - DNA, 13 bp, C. elegans
ttcaatgaattaa

SEQ ID NO: 733926 - DNA, 13 bp, C. elegans
ttcaatgaatttc

SEQ ID NO: 733927 - DNA, 13 bp, C. elegans
ttcaatgacattt

SEQ ID NO: 733928 - DNA, 13 bp, C. elegans
ttcaatgagaaat

SEQ ID NO: 733929 - DNA, 13 bp, C. elegans
ttcaatgatttca

SEQ ID NO: 733930 - DNA, 13 bp, C. elegans
ttcaatgatttgt

SEQ ID NO: 733931 - DNA, 13 bp, C. elegans
ttcaatgattttc

SEQ ID NO: 733932 - DNA, 13 bp, C. elegans
ttcaatgcaccat

SEQ ID NO: 733933 - DNA, 13 bp, C. elegans
ttcaatgccaaaa

SEQ ID NO: 733934 - DNA, 13 bp, C. elegans
ttcaatgccacca

SEQ ID NO: 733935 - DNA, 13 bp, C. elegans
ttcaatggaaaaa

SEQ ID NO: 733936 - DNA, 13 bp, C. elegans
ttcaatggttttc

SEQ ID NO: 733937 - DNA, 13 bp, C. elegans
ttcaatgtatttt

SEQ ID NO: 733938 - DNA, 13 bp, C. elegans
ttcaatgtgaaaa

SEQ ID NO: 733939 - DNA, 13 bp, C. elegans
ttcaatgttcaat

SEQ ID NO: 733940 - DNA, 13 bp, C. elegans
ttcaatgttcatt

SEQ ID NO: 733941 - DNA, 13 bp, C. elegans
ttcaatgtttaat

SEQ ID NO: 733942 - DNA, 13 bp, C. elegans
ttcaatgtttcaa

SEQ ID NO: 733943 - DNA, 13 bp, C. elegans
ttcaatgtttcca

SEQ ID NO: 733944 - DNA, 13 bp, C. elegans
ttcaatgtttgaa

SEQ ID NO: 733945 - DNA, 13 bp, C. elegans
ttcaatgtttgta

SEQ ID NO: 733946 - DNA, 13 bp, C. elegans
ttcaatgttttct

SEQ ID NO: 733947 - DNA, 13 bp, C. elegans
ttcaatgtttttc

SEQ ID NO: 733948 - DNA, 13 bp, C. elegans
ttcaattaaaact

SEQ ID NO: 733949 - DNA, 13 bp, C. elegans
ttcaattaaaagt

SEQ ID NO: 733950 - DNA, 13 bp, C. elegans
ttcaattacaaaa

SEQ ID NO: 733951 - DNA, 13 bp, C. elegans
ttcaattacttta

SEQ ID NO: 733952 - DNA, 13 bp, C. elegans
ttcaattaggaaa

SEQ ID NO: 733953 - DNA, 13 bp, C. elegans
ttcaattagtttc

SEQ ID NO: 733954 - DNA, 13 bp, C. elegans
ttcaattagtttt

SEQ ID NO: 733955 - DNA, 13 bp, C. elegans
ttcaattatatgt

SEQ ID NO: 733956 - DNA, 13 bp, C. elegans
ttcaattattact

SEQ ID NO: 733957 - DNA, 13 bp, C. elegans
ttcaattattagt

SEQ ID NO: 733958 - DNA, 13 bp, C. elegans
ttcaattattcaa

SEQ ID NO: 733959 - DNA, 13 bp, C. elegans
ttcaattattcta

SEQ ID NO: 733960 - DNA, 13 bp, C. elegans
ttcaattattgta

SEQ ID NO: 733961 - DNA, 13 bp, C. elegans
ttcaattatttac

SEQ ID NO: 733962 - DNA, 13 bp, C. elegans
ttcaattatttgt

SEQ ID NO: 733963 - DNA, 13 bp, C. elegans
ttcaattcaaaaa

SEQ ID NO: 733964 - DNA, 13 bp, C. elegans
ttcaattcaaaac

SEQ ID NO: 733965 - DNA, 13 bp, C. elegans
ttcaattcaaatc

SEQ ID NO: 733966 - DNA, 13 bp, C. elegans
ttcaattcaaatt

SEQ ID NO: 733967 - DNA, 13 bp, C. elegans
ttcaattcaatct

SEQ ID NO: 733968 - DNA, 13 bp, C. elegans
ttcaattcaatta

SEQ ID NO: 733969 - DNA, 14 bp, C. elegans
ttcaattcaattca

SEQ ID NO: 733970 - DNA, 13 bp, C. elegans
ttcaattcaattt

SEQ ID NO: 733971 - DNA, 13 bp, C. elegans
ttcaattcacttt

SEQ ID NO: 733972 - DNA, 13 bp, C. elegans
ttcaattcataaa

SEQ ID NO: 733973 - DNA, 13 bp, C. elegans
ttcaattcatgag

SEQ ID NO: 733974 - DNA, 13 bp, C. elegans
ttcaattcatttc

SEQ ID NO: 733975 - DNA, 13 bp, C. elegans
ttcaattccaaaa

SEQ ID NO: 733976 - DNA, 13 bp, C. elegans
ttcaattccaaca

SEQ ID NO: 733977 - DNA, 13 bp, C. elegans
ttcaattccaatt

SEQ ID NO: 733978 - DNA, 13 bp, C. elegans
ttcaattccagca

SEQ ID NO: 733979 - DNA, 13 bp, C. elegans
ttcaattccatca

SEQ ID NO: 733980 - DNA, 13 bp, C. elegans
ttcaattccccat

SEQ ID NO: 733981 - DNA, 13 bp, C. elegans
ttcaattccgaca

SEQ ID NO: 733982 - DNA, 13 bp, C. elegans
ttcaattccggaa

SEQ ID NO: 733983 - DNA, 13 bp, C. elegans
ttcaattccggca

SEQ ID NO: 733984 - DNA, 13 bp, C. elegans
ttcaattccgtca

SEQ ID NO: 733985 - DNA, 13 bp, C. elegans
ttcaattcgaaaa

SEQ ID NO: 733986 - DNA, 13 bp, C. elegans
ttcaattcggaaa

SEQ ID NO: 733987 - DNA, 13 bp, C. elegans
ttcaattcggatg

SEQ ID NO: 733988 - DNA, 13 bp, C. elegans
ttcaattctcaat

SEQ ID NO: 733989 - DNA, 13 bp, C. elegans
ttcaattctgaaa

SEQ ID NO: 733990 - DNA, 13 bp, C. elegans
ttcaattctgatt

SEQ ID NO: 733991 - DNA, 13 bp, C. elegans
ttcaattctgcca

SEQ ID NO: 733992 - DNA, 13 bp, C. elegans
ttcaattcttaat

SEQ ID NO: 733993 - DNA, 13 bp, C. elegans
ttcaattcttctc

SEQ ID NO: 733994 - DNA, 13 bp, C. elegans
ttcaattcttgca

SEQ ID NO: 733995 - DNA, 13 bp, C. elegans
ttcaattctttaa

SEQ ID NO: 733996 - DNA, 13 bp, C. elegans
ttcaattgaaaaa

SEQ ID NO: 733997 - DNA, 13 bp, C. elegans
ttcaattgaaaac

SEQ ID NO: 733998 - DNA, 13 bp, C. elegans
ttcaattgaaaca

SEQ ID NO: 733999 - DNA, 13 bp, C. elegans
ttcaattgaagaa

SEQ ID NO: 734000 - DNA, 13 bp, C. elegans
ttcaattgaatag

SEQ ID NO: 734001 - DNA, 13 bp, C. elegans
ttcaattgaattt

SEQ ID NO: 734002 - DNA, 13 bp, C. elegans
ttcaattgacaaa

SEQ ID NO: 734003 - DNA, 13 bp, C. elegans
ttcaattgacaat

SEQ ID NO: 734004 - DNA, 13 bp, C. elegans
ttcaattgataat

SEQ ID NO: 734005 - DNA, 13 bp, C. elegans
ttcaattgatgaa

SEQ ID NO: 734006 - DNA, 13 bp, C. elegans
ttcaattgattat

SEQ ID NO: 734007 - DNA, 13 bp, C. elegans
ttcaattggaaat

SEQ ID NO: 734008 - DNA, 13 bp, C. elegans
ttcaattggcgga

SEQ ID NO: 734009 - DNA, 13 bp, C. elegans
ttcaattgtaaaa

SEQ ID NO: 734010 - DNA, 13 bp, C. elegans
ttcaattgtatat

SEQ ID NO: 734011 - DNA, 13 bp, C. elegans
ttcaattgtattc

SEQ ID NO: 734012 - DNA, 13 bp, C. elegans
ttcaattgtcaaa

SEQ ID NO: 734013 - DNA, 13 bp, C. elegans
ttcaattgttcaa

SEQ ID NO: 734014 - DNA, 13 bp, C. elegans
ttcaattgttctt

SEQ ID NO: 734015 - DNA, 13 bp, C. elegans
ttcaattgttgat

SEQ ID NO: 734016 - DNA, 13 bp, C. elegans
ttcaattgttgtt

SEQ ID NO: 734017 - DNA, 13 bp, C. elegans
ttcaattgtttat

SEQ ID NO: 734018 - DNA, 14 bp, C. elegans
ttcaattgtttcaa

SEQ ID NO: 734019 - DNA, 13 bp, C. elegans
ttcaatttacaaa

SEQ ID NO: 734020 - DNA, 13 bp, C. elegans
ttcaatttacaat

SEQ ID NO: 734021 - DNA, 13 bp, C. elegans
ttcaatttagttt

SEQ ID NO: 734022 - DNA, 13 bp, C. elegans
ttcaatttatcaa

SEQ ID NO: 734023 - DNA, 13 bp, C. elegans
ttcaatttatgaa

SEQ ID NO: 734024 - DNA, 13 bp, C. elegans
ttcaatttatgta

SEQ ID NO: 734025 - DNA, 13 bp, C. elegans
ttcaatttatgtg

SEQ ID NO: 734026 - DNA, 13 bp, C. elegans
ttcaatttattgc

SEQ ID NO: 734027 - DNA, 13 bp, C. elegans
ttcaatttatttg

SEQ ID NO: 734028 - DNA, 13 bp, C. elegans
ttcaatttcaaaa

SEQ ID NO: 734029 - DNA, 13 bp, C. elegans
ttcaatttcaaat

SEQ ID NO: 734030 - DNA, 13 bp, C. elegans
ttcaatttcaacc

SEQ ID NO: 734031 - DNA, 13 bp, C. elegans
ttcaatttcaata

SEQ ID NO: 734032 - DNA, 13 bp, C. elegans
ttcaatttcaatc

SEQ ID NO: 734033 - DNA, 13 bp, C. elegans
ttcaatttcatat

SEQ ID NO: 734034 - DNA, 13 bp, C. elegans
ttcaatttccata

SEQ ID NO: 734035 - DNA, 13 bp, C. elegans
ttcaatttccggt

SEQ ID NO: 734036 - DNA, 13 bp, C. elegans
ttcaatttcgaca

SEQ ID NO: 734037 - DNA, 13 bp, C. elegans
ttcaatttcggaa

SEQ ID NO: 734038 - DNA, 13 bp, C. elegans
ttcaatttcgtgg

SEQ ID NO: 734039 - DNA, 13 bp, C. elegans
ttcaatttcgttt

SEQ ID NO: 734040 - DNA, 13 bp, C. elegans
ttcaatttctaac

SEQ ID NO: 734041 - DNA, 13 bp, C. elegans
ttcaatttctaca

SEQ ID NO: 734042 - DNA, 13 bp, C. elegans
ttcaatttctact

SEQ ID NO: 734043 - DNA, 13 bp, C. elegans
ttcaatttctata

SEQ ID NO: 734044 - DNA, 13 bp, C. elegans
ttcaatttctcaa

SEQ ID NO: 734045 - DNA, 13 bp, C. elegans
ttcaatttctcca

SEQ ID NO: 734046 - DNA, 13 bp, C. elegans
ttcaatttctgaa

SEQ ID NO: 734047 - DNA, 13 bp, C. elegans
ttcaatttcttaa

SEQ ID NO: 734048 - DNA, 13 bp, C. elegans
ttcaatttgaaat

SEQ ID NO: 734049 - DNA, 13 bp, C. elegans
ttcaatttgataa

SEQ ID NO: 734050 - DNA, 13 bp, C. elegans
ttcaatttgatta

SEQ ID NO: 734051 - DNA, 13 bp, C. elegans
ttcaatttggttt

SEQ ID NO: 734052 - DNA, 13 bp, C. elegans
ttcaatttgtaat

SEQ ID NO: 734053 - DNA, 13 bp, C. elegans
ttcaatttgtgtt

SEQ ID NO: 734054 - DNA, 13 bp, C. elegans
ttcaatttgttat

SEQ ID NO: 734055 - DNA, 13 bp, C. elegans
ttcaatttgttcg

SEQ ID NO: 734056 - DNA, 13 bp, C. elegans
ttcaatttgttct

SEQ ID NO: 734057 - DNA, 13 bp, C. elegans
ttcaatttgttgt

SEQ ID NO: 734058 - DNA, 13 bp, C. elegans
ttcaatttgtttg

SEQ ID NO: 734059 - DNA, 13 bp, C. elegans
ttcaattttaagc

SEQ ID NO: 734060 - DNA, 13 bp, C. elegans
ttcaattttaatc

SEQ ID NO: 734061 - DNA, 13 bp, C. elegans
ttcaattttattg

SEQ ID NO: 734062 - DNA, 13 bp, C. elegans
ttcaattttcaac

SEQ ID NO: 734063 - DNA, 13 bp, C. elegans
ttcaattttcaga

SEQ ID NO: 734064 - DNA, 13 bp, C. elegans
ttcaattttcagt

SEQ ID NO: 734065 - DNA, 13 bp, C. elegans
ttcaattttccta

SEQ ID NO: 734066 - DNA, 13 bp, C. elegans
ttcaattttcgat

SEQ ID NO: 734067 - DNA, 13 bp, C. elegans
ttcaattttcgtt

SEQ ID NO: 734068 - DNA, 13 bp, C. elegans
ttcaattttctag

SEQ ID NO: 734069 - DNA, 14 bp, C. elegans
ttcaattttgaaaa

SEQ ID NO: 734070 - DNA, 13 bp, C. elegans
ttcaattttgaca

SEQ ID NO: 734071 - DNA, 13 bp, C. elegans
ttcaattttgata

SEQ ID NO: 734072 - DNA, 13 bp, C. elegans
ttcaattttgatg

SEQ ID NO: 734073 - DNA, 13 bp, C. elegans
ttcaattttggaa

SEQ ID NO: 734074 - DNA, 13 bp, C. elegans
ttcaattttggca

SEQ ID NO: 734075 - DNA, 13 bp, C. elegans
ttcaattttggcg

SEQ ID NO: 734076 - DNA, 13 bp, C. elegans
ttcaattttgtaa

SEQ ID NO: 734077 - DNA, 13 bp, C. elegans
ttcaattttgtta

SEQ ID NO: 734078 - DNA, 13 bp, C. elegans
ttcaattttgttc

SEQ ID NO: 734079 - DNA, 13 bp, C. elegans
ttcaatttttaac

SEQ ID NO: 734080 - DNA, 13 bp, C. elegans
ttcaatttttaag

SEQ ID NO: 734081 - DNA, 13 bp, C. elegans
ttcaatttttatg

SEQ ID NO: 734082 - DNA, 13 bp, C. elegans
ttcaatttttcca

SEQ ID NO: 734083 - DNA, 13 bp, C. elegans
ttcaatttttccg

SEQ ID NO: 734084 - DNA, 13 bp, C. elegans
ttcaatttttcgg

SEQ ID NO: 734085 - DNA, 13 bp, C. elegans
ttcaatttttgac

SEQ ID NO: 734086 - DNA, 13 bp, C. elegans
ttcaatttttgat

SEQ ID NO: 734087 - DNA, 13 bp, C. elegans
ttcaatttttgtg

SEQ ID NO: 734088 - DNA, 13 bp, C. elegans
ttcacaaaaacat

SEQ ID NO: 734089 - DNA, 13 bp, C. elegans
ttcacaaaaagtg

SEQ ID NO: 734090 - DNA, 13 bp, C. elegans
ttcacaaaaatcc

SEQ ID NO: 734091 - DNA, 13 bp, C. elegans
ttcacaaaaatgt

SEQ ID NO: 734092 - DNA, 13 bp, C. elegans
ttcacaaaaatta

SEQ ID NO: 734093 - DNA, 13 bp, C. elegans
ttcacaaaacaat

SEQ ID NO: 734094 - DNA, 13 bp, C. elegans
ttcacaaaactat

SEQ ID NO: 734095 - DNA, 13 bp, C. elegans
ttcacaaaatatt

SEQ ID NO: 734096 - DNA, 13 bp, C. elegans
ttcacaaaatcta

SEQ ID NO: 734097 - DNA, 13 bp, C. elegans
ttcacaaaattaa

SEQ ID NO: 734098 - DNA, 13 bp, C. elegans
ttcacaaaattac

SEQ ID NO: 734099 - DNA, 13 bp, C. elegans
ttcacaaaattca

SEQ ID NO: 734100 - DNA, 13 bp, C. elegans
ttcacaaaatttc

SEQ ID NO: 734101 - DNA, 13 bp, C. elegans
ttcacaaacaaat

SEQ ID NO: 734102 - DNA, 13 bp, C. elegans
ttcacaaagaaat

SEQ ID NO: 734103 - DNA, 13 bp, C. elegans
ttcacaaatattt

SEQ ID NO: 734104 - DNA, 13 bp, C. elegans
ttcacaaatcaca

SEQ ID NO: 734105 - DNA, 13 bp, C. elegans
ttcacaaatgaaa

SEQ ID NO: 734106 - DNA, 13 bp, C. elegans
ttcacaaattcga

SEQ ID NO: 734107 - DNA, 13 bp, C. elegans
ttcacaaattgaa

SEQ ID NO: 734108 - DNA, 13 bp, C. elegans
ttcacaaattgcc

SEQ ID NO: 734109 - DNA, 13 bp, C. elegans
ttcacaaatttat

SEQ ID NO: 734110 - DNA, 13 bp, C. elegans
ttcacaacaacaa

SEQ ID NO: 734111 - DNA, 13 bp, C. elegans
ttcacaacttcaa

SEQ ID NO: 734112 - DNA, 13 bp, C. elegans
ttcacaagaaaac

SEQ ID NO: 734113 - DNA, 13 bp, C. elegans
ttcacaagaaaat

SEQ ID NO: 734114 - DNA, 13 bp, C. elegans
ttcacaataattt

SEQ ID NO: 734115 - DNA, 13 bp, C. elegans
ttcacaattaaat

SEQ ID NO: 734116 - DNA, 13 bp, C. elegans
ttcacaatttaca

SEQ ID NO: 734117 - DNA, 13 bp, C. elegans
ttcacaatttatt

SEQ ID NO: 734118 - DNA, 13 bp, C. elegans
ttcacaatttcca

SEQ ID NO: 734119 - DNA, 13 bp, C. elegans
ttcacaatttccc

SEQ ID NO: 734120 - DNA, 13 bp, C. elegans
ttcacaatttctt

SEQ ID NO: 734121 - DNA, 13 bp, C. elegans
ttcacaattttat

SEQ ID NO: 734122 - DNA, 13 bp, C. elegans
ttcacaattttct

SEQ ID NO: 734123 - DNA, 13 bp, C. elegans
ttcacaattttga

SEQ ID NO: 734124 - DNA, 13 bp, C. elegans
ttcacacaaaaat

SEQ ID NO: 734125 - DNA, 13 bp, C. elegans
ttcacacacacac

SEQ ID NO: 734126 - DNA, 13 bp, C. elegans
ttcacacactttt

SEQ ID NO: 734127 - DNA, 13 bp, C. elegans
ttcacacattttt

SEQ ID NO: 734128 - DNA, 13 bp, C. elegans
ttcacactatttc

SEQ ID NO: 734129 - DNA, 13 bp, C. elegans
ttcacactgtttt

SEQ ID NO: 734130 - DNA, 13 bp, C. elegans
ttcacacttttaa

SEQ ID NO: 734131 - DNA, 13 bp, C. elegans
ttcacacttttcg

SEQ ID NO: 734132 - DNA, 13 bp, C. elegans
ttcacagaaaaat

SEQ ID NO: 734133 - DNA, 13 bp, C. elegans
ttcacagaaattt

SEQ ID NO: 734134 - DNA, 13 bp, C. elegans
ttcacagaataat

SEQ ID NO: 734135 - DNA, 13 bp, C. elegans
ttcacagattttc

SEQ ID NO: 734136 - DNA, 13 bp, C. elegans
ttcacagcaaaaa

SEQ ID NO: 734137 - DNA, 13 bp, C. elegans
ttcacagcttttc

SEQ ID NO: 734138 - DNA, 13 bp, C. elegans
ttcacagtgaaaa

SEQ ID NO: 734139 - DNA, 13 bp, C. elegans
ttcacagtttaaa

SEQ ID NO: 734140 - DNA, 13 bp, C. elegans
ttcacagttttta

SEQ ID NO: 734141 - DNA, 13 bp, C. elegans
ttcacagtttttt

SEQ ID NO: 734142 - DNA, 13 bp, C. elegans
ttcacataaaata

SEQ ID NO: 734143 - DNA, 13 bp, C. elegans
ttcacataaatta

SEQ ID NO: 734144 - DNA, 13 bp, C. elegans
ttcacataatttc

SEQ ID NO: 734145 - DNA, 13 bp, C. elegans
ttcacatagattt

SEQ ID NO: 734146 - DNA, 13 bp, C. elegans
ttcacatagtttt

SEQ ID NO: 734147 - DNA, 13 bp, C. elegans
ttcacatatattt

SEQ ID NO: 734148 - DNA, 13 bp, C. elegans
ttcacatatttca

SEQ ID NO: 734149 - DNA, 13 bp, C. elegans
ttcacatgaaaat

SEQ ID NO: 734150 - DNA, 13 bp, C. elegans
ttcacatgatttt

SEQ ID NO: 734151 - DNA, 13 bp, C. elegans
ttcacatgtttca

SEQ ID NO: 734152 - DNA, 13 bp, C. elegans
ttcacatgttttc

SEQ ID NO: 734153 - DNA, 13 bp, C. elegans
ttcacattaattt

SEQ ID NO: 734154 - DNA, 13 bp, C. elegans
ttcacattcaaaa

SEQ ID NO: 734155 - DNA, 13 bp, C. elegans
ttcacatttaaat

SEQ ID NO: 734156 - DNA, 13 bp, C. elegans
ttcacatttattc

SEQ ID NO: 734157 - DNA, 13 bp, C. elegans
ttcacatttcaaa

SEQ ID NO: 734158 - DNA, 13 bp, C. elegans
ttcacatttcaac

SEQ ID NO: 734159 - DNA, 13 bp, C. elegans
ttcacatttcttc

SEQ ID NO: 734160 - DNA, 13 bp, C. elegans
ttcacattttcaa

SEQ ID NO: 734161 - DNA, 13 bp, C. elegans
ttcacattttcca

SEQ ID NO: 734162 - DNA, 13 bp, C. elegans
ttcacattttgct

SEQ ID NO: 734163 - DNA, 13 bp, C. elegans
ttcacatttttcc

SEQ ID NO: 734164 - DNA, 13 bp, C. elegans
ttcaccaaaaata

SEQ ID NO: 734165 - DNA, 13 bp, C. elegans
ttcaccaaaaatg

SEQ ID NO: 734166 - DNA, 13 bp, C. elegans
ttcaccaaaatta

SEQ ID NO: 734167 - DNA, 13 bp, C. elegans
ttcaccaaatttt

SEQ ID NO: 734168 - DNA, 13 bp, C. elegans
ttcaccaatattt

SEQ ID NO: 734169 - DNA, 14 bp, C. elegans
ttcaccaattattt

SEQ ID NO: 734170 - DNA, 13 bp, C. elegans
ttcaccaatttcc

SEQ ID NO: 734171 - DNA, 13 bp, C. elegans
ttcaccaattttc

SEQ ID NO: 734172 - DNA, 13 bp, C. elegans
ttcaccacaaaaa

SEQ ID NO: 734173 - DNA, 13 bp, C. elegans
ttcaccagttttc

SEQ ID NO: 734174 - DNA, 13 bp, C. elegans
ttcaccatatatt

SEQ ID NO: 734175 - DNA, 13 bp, C. elegans
ttcaccatttcaa

SEQ ID NO: 734176 - DNA, 13 bp, C. elegans
ttcaccattttct

SEQ ID NO: 734177 - DNA, 13 bp, C. elegans
ttcacccaaaaaa

SEQ ID NO: 734178 - DNA, 13 bp, C. elegans
ttcaccccgaaaa

SEQ ID NO: 734179 - DNA, 13 bp, C. elegans
ttcacccgttttt

SEQ ID NO: 734180 - DNA, 13 bp, C. elegans
ttcaccgaaaaaa

SEQ ID NO: 734181 - DNA, 13 bp, C. elegans
ttcaccgaaaatt

SEQ ID NO: 734182 - DNA, 13 bp, C. elegans
ttcacctaaaatt

SEQ ID NO: 734183 - DNA, 13 bp, C. elegans
ttcacctaattat

SEQ ID NO: 734184 - DNA, 13 bp, C. elegans
ttcacctggaaaa

SEQ ID NO: 734185 - DNA, 13 bp, C. elegans
ttcacctgttctc

SEQ ID NO: 734186 - DNA, 13 bp, C. elegans
ttcacgaaaaata

SEQ ID NO: 734187 - DNA, 13 bp, C. elegans
ttcacgaaaaatc

SEQ ID NO: 734188 - DNA, 13 bp, C. elegans
ttcacgaaaaatt

SEQ ID NO: 734189 - DNA, 13 bp, C. elegans
ttcacgaaaatct

SEQ ID NO: 734190 - DNA, 13 bp, C. elegans
ttcacgattttca

SEQ ID NO: 734191 - DNA, 13 bp, C. elegans
ttcacgatttttg

SEQ ID NO: 734192 - DNA, 13 bp, C. elegans
ttcacgtaaaaat

SEQ ID NO: 734193 - DNA, 13 bp, C. elegans
ttcacgtgaattt

SEQ ID NO: 734194 - DNA, 13 bp, C. elegans
ttcacgttcaaaa

SEQ ID NO: 734195 - DNA, 13 bp, C. elegans
ttcacgtttaaaa

SEQ ID NO: 734196 - DNA, 13 bp, C. elegans
ttcacgtttcaat

SEQ ID NO: 734197 - DNA, 13 bp, C. elegans
ttcacgttttcat

SEQ ID NO: 734198 - DNA, 13 bp, C. elegans
ttcacgtttttca

SEQ ID NO: 734199 - DNA, 13 bp, C. elegans
ttcacgtttttct

SEQ ID NO: 734200 - DNA, 13 bp, C. elegans
ttcactaaaaatc

SEQ ID NO: 734201 - DNA, 13 bp, C. elegans
ttcactaaaaatg

SEQ ID NO: 734202 - DNA, 13 bp, C. elegans
ttcactaaatatt

SEQ ID NO: 734203 - DNA, 13 bp, C. elegans
ttcactactttgg

SEQ ID NO: 734204 - DNA, 13 bp, C. elegans
ttcactactttta

SEQ ID NO: 734205 - DNA, 13 bp, C. elegans
ttcactagaaaat

SEQ ID NO: 734206 - DNA, 13 bp, C. elegans
ttcactagaataa

SEQ ID NO: 734207 - DNA, 13 bp, C. elegans
ttcactatgatat

SEQ ID NO: 734208 - DNA, 13 bp, C. elegans
ttcactattttaa

SEQ ID NO: 734209 - DNA, 13 bp, C. elegans
ttcactattttca

SEQ ID NO: 734210 - DNA, 13 bp, C. elegans
ttcactattttcc

SEQ ID NO: 734211 - DNA, 13 bp, C. elegans
ttcactcaaaatc

SEQ ID NO: 734212 - DNA, 13 bp, C. elegans
ttcactcaatctg

SEQ ID NO: 734213 - DNA, 13 bp, C. elegans
ttcactcaatttt

SEQ ID NO: 734214 - DNA, 13 bp, C. elegans
ttcactcagtttc

SEQ ID NO: 734215 - DNA, 13 bp, C. elegans
ttcactcatttct

SEQ ID NO: 734216 - DNA, 13 bp, C. elegans
ttcactcgaaatt

SEQ ID NO: 734217 - DNA, 13 bp, C. elegans
ttcactcgatttt

SEQ ID NO: 734218 - DNA, 13 bp, C. elegans
ttcactgaaaaat

SEQ ID NO: 734219 - DNA, 13 bp, C. elegans
ttcactgaaaagt

SEQ ID NO: 734220 - DNA, 13 bp, C. elegans
ttcactgaaaata

SEQ ID NO: 734221 - DNA, 13 bp, C. elegans
ttcactgacaaaa

SEQ ID NO: 734222 - DNA, 13 bp, C. elegans
ttcactggaaaaa

SEQ ID NO: 734223 - DNA, 13 bp, C. elegans
ttcactggttttt

SEQ ID NO: 734224 - DNA, 13 bp, C. elegans
ttcactgtaaaaa

SEQ ID NO: 734225 - DNA, 13 bp, C. elegans
ttcactgtatttt

SEQ ID NO: 734226 - DNA, 13 bp, C. elegans
ttcactgtcaaaa

SEQ ID NO: 734227 - DNA, 13 bp, C. elegans
ttcactgtttcaa

SEQ ID NO: 734228 - DNA, 13 bp, C. elegans
ttcactgttttat

SEQ ID NO: 734229 - DNA, 13 bp, C. elegans
ttcactgttttct

SEQ ID NO: 734230 - DNA, 13 bp, C. elegans
ttcactgtttttc

SEQ ID NO: 734231 - DNA, 13 bp, C. elegans
ttcacttaaaaat

SEQ ID NO: 734232 - DNA, 13 bp, C. elegans
ttcacttaaaatc

SEQ ID NO: 734233 - DNA, 13 bp, C. elegans
ttcacttcaaaac

SEQ ID NO: 734234 - DNA, 13 bp, C. elegans
ttcacttcaaaat

SEQ ID NO: 734235 - DNA, 13 bp, C. elegans
ttcacttcatatt

SEQ ID NO: 734236 - DNA, 13 bp, C. elegans
ttcacttccaatt

SEQ ID NO: 734237 - DNA, 13 bp, C. elegans
ttcactttcaaac

SEQ ID NO: 734238 - DNA, 13 bp, C. elegans
ttcactttcaatt

SEQ ID NO: 734239 - DNA, 13 bp, C. elegans
ttcactttgaaaa

SEQ ID NO: 734240 - DNA, 13 bp, C. elegans
ttcactttgaaat

SEQ ID NO: 734241 - DNA, 13 bp, C. elegans
ttcactttgatat

SEQ ID NO: 734242 - DNA, 13 bp, C. elegans
ttcactttggatg

SEQ ID NO: 734243 - DNA, 13 bp, C. elegans
ttcacttttacaa

SEQ ID NO: 734244 - DNA, 13 bp, C. elegans
ttcacttttatca

SEQ ID NO: 734245 - DNA, 13 bp, C. elegans
ttcacttttcttg

SEQ ID NO: 734246 - DNA, 13 bp, C. elegans
ttcacttttgaat

SEQ ID NO: 734247 - DNA, 13 bp, C. elegans
ttcacttttgcaa

SEQ ID NO: 734248 - DNA, 13 bp, C. elegans
ttcacttttggaa

SEQ ID NO: 734249 - DNA, 13 bp, C. elegans
ttcactttttcag

SEQ ID NO: 734250 - DNA, 13 bp, C. elegans
ttcactttttcca

SEQ ID NO: 734251 - DNA, 13 bp, C. elegans
ttcactttttcgt

SEQ ID NO: 734252 - DNA, 13 bp, C. elegans
ttcactttttctg

SEQ ID NO: 734253 - DNA, 13 bp, C. elegans
ttcactttttgag

SEQ ID NO: 734254 - DNA, 13 bp, C. elegans
ttcactttttgat

SEQ ID NO: 734255 - DNA, 13 bp, C. elegans
ttcactttttgct

SEQ ID NO: 734256 - DNA, 13 bp, C. elegans
ttcacttttttgc

SEQ ID NO: 734257 - DNA, 13 bp, C. elegans
ttcagaaaaaagc

SEQ ID NO: 734258 - DNA, 13 bp, C. elegans
ttcagaaaaaagt

SEQ ID NO: 734259 - DNA, 13 bp, C. elegans
ttcagaaaaaatt

SEQ ID NO: 734260 - DNA, 13 bp, C. elegans
ttcagaaaaacct

SEQ ID NO: 734261 - DNA, 13 bp, C. elegans
ttcagaaaaagct

SEQ ID NO: 734262 - DNA, 13 bp, C. elegans
ttcagaaaaagtt

SEQ ID NO: 734263 - DNA, 13 bp, C. elegans
ttcagaaaaatag

SEQ ID NO: 734264 - DNA, 13 bp, C. elegans
ttcagaaaaatat

SEQ ID NO: 734265 - DNA, 13 bp, C. elegans
ttcagaaaaatca

SEQ ID NO: 734266 - DNA, 13 bp, C. elegans
ttcagaaaacaac

SEQ ID NO: 734267 - DNA, 13 bp, C. elegans
ttcagaaaacata

SEQ ID NO: 734268 - DNA, 13 bp, C. elegans
ttcagaaaacatt

SEQ ID NO: 734269 - DNA, 13 bp, C. elegans
ttcagaaaacgtt

SEQ ID NO: 734270 - DNA, 13 bp, C. elegans
ttcagaaaactat

SEQ ID NO: 734271 - DNA, 13 bp, C. elegans
ttcagaaaactgt

SEQ ID NO: 734272 - DNA, 13 bp, C. elegans
ttcagaaaagatt

SEQ ID NO: 734273 - DNA, 13 bp, C. elegans
ttcagaaaagtga

SEQ ID NO: 734274 - DNA, 13 bp, C. elegans
ttcagaaaagtta

SEQ ID NO: 734275 - DNA, 14 bp, C. elegans
ttcagaaaataatt

SEQ ID NO: 734276 - DNA, 13 bp, C. elegans
ttcagaaaataca

SEQ ID NO: 734277 - DNA, 13 bp, C. elegans
ttcagaaaatatt

SEQ ID NO: 734278 - DNA, 13 bp, C. elegans
ttcagaaaatcgg

SEQ ID NO: 734279 - DNA, 13 bp, C. elegans
ttcagaaaatcta

SEQ ID NO: 734280 - DNA, 13 bp, C. elegans
ttcagaaaatctc

SEQ ID NO: 734281 - DNA, 13 bp, C. elegans
ttcagaaaatgat

SEQ ID NO: 734282 - DNA, 13 bp, C. elegans
ttcagaaaatgta

SEQ ID NO: 734283 - DNA, 13 bp, C. elegans
ttcagaaaattct

SEQ ID NO: 734284 - DNA, 13 bp, C. elegans
ttcagaaacattg

SEQ ID NO: 734285 - DNA, 13 bp, C. elegans
ttcagaaacattt

SEQ ID NO: 734286 - DNA, 13 bp, C. elegans
ttcagaaactatt

SEQ ID NO: 734287 - DNA, 13 bp, C. elegans
ttcagaaactgaa

SEQ ID NO: 734288 - DNA, 13 bp, C. elegans
ttcagaaagtgaa

SEQ ID NO: 734289 - DNA, 13 bp, C. elegans
ttcagaaagttaa

SEQ ID NO: 734290 - DNA, 13 bp, C. elegans
ttcagaaagttat

SEQ ID NO: 734291 - DNA, 13 bp, C. elegans
ttcagaaagttca

SEQ ID NO: 734292 - DNA, 13 bp, C. elegans
ttcagaaagtttg

SEQ ID NO: 734293 - DNA, 13 bp, C. elegans
ttcagaaataaaa

SEQ ID NO: 734294 - DNA, 13 bp, C. elegans
ttcagaaatcaat

SEQ ID NO: 734295 - DNA, 13 bp, C. elegans
ttcagaaatctca

SEQ ID NO: 734296 - DNA, 13 bp, C. elegans
ttcagaaatcttt

SEQ ID NO: 734297 - DNA, 13 bp, C. elegans
ttcagaaatgtat

SEQ ID NO: 734298 - DNA, 13 bp, C. elegans
ttcagaaattaat

SEQ ID NO: 734299 - DNA, 13 bp, C. elegans
ttcagaaattcct

SEQ ID NO: 734300 - DNA, 13 bp, C. elegans
ttcagaaattcta

SEQ ID NO: 734301 - DNA, 13 bp, C. elegans
ttcagaaattgtt

SEQ ID NO: 734302 - DNA, 13 bp, C. elegans
ttcagaaatttat

SEQ ID NO: 734303 - DNA, 13 bp, C. elegans
ttcagaacgtttt

SEQ ID NO: 734304 - DNA, 13 bp, C. elegans
ttcagaacttcaa

SEQ ID NO: 734305 - DNA, 13 bp, C. elegans
ttcagaactttca

SEQ ID NO: 734306 - DNA, 13 bp, C. elegans
ttcagaagaaaaa

SEQ ID NO: 734307 - DNA, 13 bp, C. elegans
ttcagaagaaaat

SEQ ID NO: 734308 - DNA, 13 bp, C. elegans
ttcagaagaagaa

SEQ ID NO: 734309 - DNA, 13 bp, C. elegans
ttcagaagaagat

SEQ ID NO: 734310 - DNA, 13 bp, C. elegans
ttcagaagagttt

SEQ ID NO: 734311 - DNA, 13 bp, C. elegans
ttcagaagattct

SEQ ID NO: 734312 - DNA, 28 bp, C. elegans
ttcagaagcctggacattcaccaaagct

SEQ ID NO: 734313 - DNA, 13 bp, C. elegans
ttcagaagcttca

SEQ ID NO: 734314 - DNA, 13 bp, C. elegans
ttcagaagtattt

SEQ ID NO: 734315 - DNA, 13 bp, C. elegans
ttcagaagttcaa

SEQ ID NO: 734316 - DNA, 13 bp, C. elegans
ttcagaagtttct

SEQ ID NO: 734317 - DNA, 13 bp, C. elegans
ttcagaagtttta

SEQ ID NO: 734318 - DNA, 13 bp, C. elegans
ttcagaatacatt

SEQ ID NO: 734319 - DNA, 13 bp, C. elegans
ttcagaatatttt

SEQ ID NO: 734320 - DNA, 13 bp, C. elegans
ttcagaatcaaaa

SEQ ID NO: 734321 - DNA, 13 bp, C. elegans
ttcagaatgttca

SEQ ID NO: 734322 - DNA, 13 bp, C. elegans
ttcagaattaaat

SEQ ID NO: 734323 - DNA, 13 bp, C. elegans
ttcagaattcagt

SEQ ID NO: 734324 - DNA, 13 bp, C. elegans
ttcagaattctca

SEQ ID NO: 734325 - DNA, 13 bp, C. elegans
ttcagaattgttg

SEQ ID NO: 734326 - DNA, 13 bp, C. elegans
ttcagaatttcta

SEQ ID NO: 734327 - DNA, 13 bp, C. elegans
ttcagaattttaa

SEQ ID NO: 734328 - DNA, 13 bp, C. elegans
ttcagaattttca

SEQ ID NO: 734329 - DNA, 13 bp, C. elegans
ttcagacaacttt

SEQ ID NO: 734330 - DNA, 14 bp, C. elegans
ttcagacaattttg

SEQ ID NO: 734331 - DNA, 13 bp, C. elegans
ttcagacacaaaa

SEQ ID NO: 734332 - DNA, 13 bp, C. elegans
ttcagacactttt

SEQ ID NO: 734333 - DNA, 13 bp, C. elegans
ttcagacatttta

SEQ ID NO: 734334 - DNA, 13 bp, C. elegans
ttcagacgaaaac

SEQ ID NO: 734335 - DNA, 13 bp, C. elegans
ttcagacgatttt

SEQ ID NO: 734336 - DNA, 13 bp, C. elegans
ttcagactaaaac

SEQ ID NO: 734337 - DNA, 13 bp, C. elegans
ttcagactgtttt

SEQ ID NO: 734338 - DNA, 13 bp, C. elegans
ttcagacttctcc

SEQ ID NO: 734339 - DNA, 13 bp, C. elegans
ttcagactttgaa

SEQ ID NO: 734340 - DNA, 13 bp, C. elegans
ttcagagaaaaaa

SEQ ID NO: 734341 - DNA, 13 bp, C. elegans
ttcagagaaaaag

SEQ ID NO: 734342 - DNA, 13 bp, C. elegans
ttcagagaaaaat

SEQ ID NO: 734343 - DNA, 13 bp, C. elegans
ttcagagaaaact

SEQ ID NO: 734344 - DNA, 13 bp, C. elegans
ttcagagagagag

SEQ ID NO: 734345 - DNA, 13 bp, C. elegans
ttcagagagattt

SEQ ID NO: 734346 - DNA, 13 bp, C. elegans
ttcagagagtttt

SEQ ID NO: 734347 - DNA, 13 bp, C. elegans
ttcagagatattt

SEQ ID NO: 734348 - DNA, 13 bp, C. elegans
ttcagagcaaaaa

SEQ ID NO: 734349 - DNA, 13 bp, C. elegans
ttcagaggatttt

SEQ ID NO: 734350 - DNA, 13 bp, C. elegans
ttcagataaatat

SEQ ID NO: 734351 - DNA, 13 bp, C. elegans
ttcagataattat

SEQ ID NO: 734352 - DNA, 13 bp, C. elegans
ttcagatacagtc

SEQ ID NO: 734353 - DNA, 13 bp, C. elegans
ttcagatataaat

SEQ ID NO: 734354 - DNA, 13 bp, C. elegans
ttcagatcaaaat

SEQ ID NO: 734355 - DNA, 13 bp, C. elegans
ttcagatgaaatc

SEQ ID NO: 734356 - DNA, 13 bp, C. elegans
ttcagatgaattt

SEQ ID NO: 734357 - DNA, 13 bp, C. elegans
ttcagatgatttt

SEQ ID NO: 734358 - DNA, 13 bp, C. elegans
ttcagatgggtct

SEQ ID NO: 734359 - DNA, 13 bp, C. elegans
ttcagattattct

SEQ ID NO: 734360 - DNA, 13 bp, C. elegans
ttcagattcaatt

SEQ ID NO: 734361 - DNA, 13 bp, C. elegans
ttcagattcagaa

SEQ ID NO: 734362 - DNA, 13 bp, C. elegans
ttcagatttcaat

SEQ ID NO: 734363 - DNA, 13 bp, C. elegans
ttcagattttagc

SEQ ID NO: 734364 - DNA, 13 bp, C. elegans
ttcagattttcaa

SEQ ID NO: 734365 - DNA, 13 bp, C. elegans
ttcagattttcag

SEQ ID NO: 734366 - DNA, 13 bp, C. elegans
ttcagattttcca

SEQ ID NO: 734367 - DNA, 13 bp, C. elegans
ttcagattttccg

SEQ ID NO: 734368 - DNA, 13 bp, C. elegans
ttcagattttcct

SEQ ID NO: 734369 - DNA, 13 bp, C. elegans
ttcagatttttag

SEQ ID NO: 734370 - DNA, 13 bp, C. elegans
ttcagcaaaaatc

SEQ ID NO: 734371 - DNA, 13 bp, C. elegans
ttcagcaaaagtt

SEQ ID NO: 734372 - DNA, 13 bp, C. elegans
ttcagcaaaatta

SEQ ID NO: 734373 - DNA, 13 bp, C. elegans
ttcagcaaaattg

SEQ ID NO: 734374 - DNA, 13 bp, C. elegans
ttcagcaacaaaa

SEQ ID NO: 734375 - DNA, 13 bp, C. elegans
ttcagcaatttca

SEQ ID NO: 734376 - DNA, 13 bp, C. elegans
ttcagcaatttcc

SEQ ID NO: 734377 - DNA, 13 bp, C. elegans
ttcagcacaaatt

SEQ ID NO: 734378 - DNA, 13 bp, C. elegans
ttcagcagaaaaa

SEQ ID NO: 734379 - DNA, 13 bp, C. elegans
ttcagcagaaaat

SEQ ID NO: 734380 - DNA, 13 bp, C. elegans
ttcagcattttag

SEQ ID NO: 734381 - DNA, 13 bp, C. elegans
ttcagcattttta

SEQ ID NO: 734382 - DNA, 13 bp, C. elegans
ttcagccaaaaat

SEQ ID NO: 734383 - DNA, 13 bp, C. elegans
ttcagccaattca

SEQ ID NO: 734384 - DNA, 13 bp, C. elegans
ttcagccaattta

SEQ ID NO: 734385 - DNA, 13 bp, C. elegans
ttcagccagaaaa

SEQ ID NO: 734386 - DNA, 13 bp, C. elegans
ttcagccattttt

SEQ ID NO: 734387 - DNA, 13 bp, C. elegans
ttcagccgaaaaa

SEQ ID NO: 734388 - DNA, 13 bp, C. elegans
ttcagccgaaaat

SEQ ID NO: 734389 - DNA, 13 bp, C. elegans
ttcagccgaattt

SEQ ID NO: 734390 - DNA, 13 bp, C. elegans
ttcagccgatttc

SEQ ID NO: 734391 - DNA, 13 bp, C. elegans
ttcagccggaaaa

SEQ ID NO: 734392 - DNA, 13 bp, C. elegans
ttcagcgaaaaat

SEQ ID NO: 734393 - DNA, 13 bp, C. elegans
ttcagcgaaaatc

SEQ ID NO: 734394 - DNA, 13 bp, C. elegans
ttcagcgaatttc

SEQ ID NO: 734395 - DNA, 13 bp, C. elegans
ttcagcgaatttt

SEQ ID NO: 734396 - DNA, 13 bp, C. elegans
ttcagcgattttt

SEQ ID NO: 734397 - DNA, 13 bp, C. elegans
ttcagcggaaaat

SEQ ID NO: 734398 - DNA, 13 bp, C. elegans
ttcagcgttaaaa

SEQ ID NO: 734399 - DNA, 13 bp, C. elegans
ttcagctacagta

SEQ ID NO: 734400 - DNA, 13 bp, C. elegans
ttcagctagaaat

SEQ ID NO: 734401 - DNA, 13 bp, C. elegans
ttcagctcaaaaa

SEQ ID NO: 734402 - DNA, 13 bp, C. elegans
ttcagctccagaa

SEQ ID NO: 734403 - DNA, 13 bp, C. elegans
ttcagctcgacca

SEQ ID NO: 734404 - DNA, 13 bp, C. elegans
ttcagctcgccga

SEQ ID NO: 734405 - DNA, 13 bp, C. elegans
ttcagctctaaaa

SEQ ID NO: 734406 - DNA, 13 bp, C. elegans
ttcagctgaaaaa

SEQ ID NO: 734407 - DNA, 13 bp, C. elegans
ttcagctgaaaat

SEQ ID NO: 734408 - DNA, 13 bp, C. elegans
ttcagcttttccc

SEQ ID NO: 734409 - DNA, 13 bp, C. elegans
ttcagcttttgaa

SEQ ID NO: 734410 - DNA, 13 bp, C. elegans
ttcagcttttgat

SEQ ID NO: 734411 - DNA, 13 bp, C. elegans
ttcagcttttttg

SEQ ID NO: 734412 - DNA, 13 bp, C. elegans
ttcaggaaaaaat

SEQ ID NO: 734413 - DNA, 13 bp, C. elegans
ttcaggaaaaagt

SEQ ID NO: 734414 - DNA, 13 bp, C. elegans
ttcaggaaaataa

SEQ ID NO: 734415 - DNA, 13 bp, C. elegans
ttcaggaaatttt

SEQ ID NO: 734416 - DNA, 13 bp, C. elegans
ttcaggacttttt

SEQ ID NO: 734417 - DNA, 13 bp, C. elegans
ttcaggatatttt

SEQ ID NO: 734418 - DNA, 13 bp, C. elegans
ttcaggatttttt

SEQ ID NO: 734419 - DNA, 13 bp, C. elegans
ttcaggccaattt

SEQ ID NO: 734420 - DNA, 13 bp, C. elegans
ttcaggccatttt

SEQ ID NO: 734421 - DNA, 13 bp, C. elegans
ttcaggcgaattt

SEQ ID NO: 734422 - DNA, 13 bp, C. elegans
ttcagggaaaatc

SEQ ID NO: 734423 - DNA, 13 bp, C. elegans
ttcaggtattttt

SEQ ID NO: 734424 - DNA, 13 bp, C. elegans
ttcaggttactgt

SEQ ID NO: 734425 - DNA, 13 bp, C. elegans
ttcagtaaaaact

SEQ ID NO: 734426 - DNA, 13 bp, C. elegans
ttcagtaaaaatt

SEQ ID NO: 734427 - DNA, 13 bp, C. elegans
ttcagtaaaacaa

SEQ ID NO: 734428 - DNA, 13 bp, C. elegans
ttcagtaaaagtt

SEQ ID NO: 734429 - DNA, 13 bp, C. elegans
ttcagtaaattaa

SEQ ID NO: 734430 - DNA, 13 bp, C. elegans
ttcagtaagaaaa

SEQ ID NO: 734431 - DNA, 13 bp, C. elegans
ttcagtaatattt

SEQ ID NO: 734432 - DNA, 13 bp, C. elegans
ttcagtacaaatt

SEQ ID NO: 734433 - DNA, 13 bp, C. elegans
ttcagtactacat

SEQ ID NO: 734434 - DNA, 13 bp, C. elegans
ttcagtagatcaa

SEQ ID NO: 734435 - DNA, 13 bp, C. elegans
ttcagtagtcaaa

SEQ ID NO: 734436 - DNA, 13 bp, C. elegans
ttcagtatatttt

SEQ ID NO: 734437 - DNA, 13 bp, C. elegans
ttcagtatgaaaa

SEQ ID NO: 734438 - DNA, 13 bp, C. elegans
ttcagtattaaaa

SEQ ID NO: 734439 - DNA, 13 bp, C. elegans
ttcagtattcaaa

SEQ ID NO: 734440 - DNA, 13 bp, C. elegans
ttcagtatttctt

SEQ ID NO: 734441 - DNA, 13 bp, C. elegans
ttcagtatttgaa

SEQ ID NO: 734442 - DNA, 13 bp, C. elegans
ttcagtatttgcc

SEQ ID NO: 734443 - DNA, 13 bp, C. elegans
ttcagtattttcc

SEQ ID NO: 734444 - DNA, 13 bp, C. elegans
ttcagtattttta

SEQ ID NO: 734445 - DNA, 13 bp, C. elegans
ttcagtcaaaaat

SEQ ID NO: 734446 - DNA, 13 bp, C. elegans
ttcagtcaaagtt

SEQ ID NO: 734447 - DNA, 13 bp, C. elegans
ttcagtcaagttt

SEQ ID NO: 734448 - DNA, 13 bp, C. elegans
ttcagtcagaaaa

SEQ ID NO: 734449 - DNA, 13 bp, C. elegans
ttcagtcattttg

SEQ ID NO: 734450 - DNA, 13 bp, C. elegans
ttcagtcattttt

SEQ ID NO: 734451 - DNA, 13 bp, C. elegans
ttcagtccaaaat

SEQ ID NO: 734452 - DNA, 13 bp, C. elegans
ttcagtgaaaaac

SEQ ID NO: 734453 - DNA, 13 bp, C. elegans
ttcagtgaaaatg

SEQ ID NO: 734454 - DNA, 13 bp, C. elegans
ttcagtgaagaaa

SEQ ID NO: 734455 - DNA, 13 bp, C. elegans
ttcagtgattttc

SEQ ID NO: 734456 - DNA, 13 bp, C. elegans
ttcagtgattttt

SEQ ID NO: 734457 - DNA, 13 bp, C. elegans
ttcagtgcatttt

SEQ ID NO: 734458 - DNA, 13 bp, C. elegans
ttcagtggaaaat

SEQ ID NO: 734459 - DNA, 13 bp, C. elegans
ttcagtggatttt

SEQ ID NO: 734460 - DNA, 13 bp, C. elegans
ttcagtgggaaaa

SEQ ID NO: 734461 - DNA, 13 bp, C. elegans
ttcagtgtgtttt

SEQ ID NO: 734462 - DNA, 13 bp, C. elegans
ttcagtgttttca

SEQ ID NO: 734463 - DNA, 13 bp, C. elegans
ttcagtgttttta

SEQ ID NO: 734464 - DNA, 13 bp, C. elegans
ttcagtgtttttc

SEQ ID NO: 734465 - DNA, 13 bp, C. elegans
ttcagttagaaat

SEQ ID NO: 734466 - DNA, 13 bp, C. elegans
ttcagttcaaaaa

SEQ ID NO: 734467 - DNA, 13 bp, C. elegans
ttcagttcaaaat

SEQ ID NO: 734468 - DNA, 13 bp, C. elegans
ttcagttcaatca

SEQ ID NO: 734469 - DNA, 13 bp, C. elegans
ttcagttcatttc

SEQ ID NO: 734470 - DNA, 13 bp, C. elegans
ttcagttctcaaa

SEQ ID NO: 734471 - DNA, 13 bp, C. elegans
ttcagttgaaatt

SEQ ID NO: 734472 - DNA, 13 bp, C. elegans
ttcagttgaactt

SEQ ID NO: 734473 - DNA, 13 bp, C. elegans
ttcagttgcaaaa

SEQ ID NO: 734474 - DNA, 13 bp, C. elegans
ttcagttggaaaa

SEQ ID NO: 734475 - DNA, 13 bp, C. elegans
ttcagttggtttt

SEQ ID NO: 734476 - DNA, 13 bp, C. elegans
ttcagttgttcaa

SEQ ID NO: 734477 - DNA, 13 bp, C. elegans
ttcagttgtttca

SEQ ID NO: 734478 - DNA, 13 bp, C. elegans
ttcagttgttttg

SEQ ID NO: 734479 - DNA, 13 bp, C. elegans
ttcagtttaattt

SEQ ID NO: 734480 - DNA, 13 bp, C. elegans
ttcagtttacaaa

SEQ ID NO: 734481 - DNA, 13 bp, C. elegans
ttcagtttatttc

SEQ ID NO: 734482 - DNA, 13 bp, C. elegans
ttcagtttcaaaa

SEQ ID NO: 734483 - DNA, 13 bp, C. elegans
ttcagtttcaaat

SEQ ID NO: 734484 - DNA, 13 bp, C. elegans
ttcagtttcaaca

SEQ ID NO: 734485 - DNA, 13 bp, C. elegans
ttcagtttccaat

SEQ ID NO: 734486 - DNA, 13 bp, C. elegans
ttcagtttctcaa

SEQ ID NO: 734487 - DNA, 13 bp, C. elegans
ttcagtttctgtt

SEQ ID NO: 734488 - DNA, 13 bp, C. elegans
ttcagtttgagaa

SEQ ID NO: 734489 - DNA, 13 bp, C. elegans
ttcagttttaatt

SEQ ID NO: 734490 - DNA, 13 bp, C. elegans
ttcagttttagtt

SEQ ID NO: 734491 - DNA, 13 bp, C. elegans
ttcagttttatta

SEQ ID NO: 734492 - DNA, 13 bp, C. elegans
ttcagttttattc

SEQ ID NO: 734493 - DNA, 13 bp, C. elegans
ttcagttttcaat

SEQ ID NO: 734494 - DNA, 13 bp, C. elegans
ttcagttttcccc

SEQ ID NO: 734495 - DNA, 13 bp, C. elegans
ttcagttttcctt

SEQ ID NO: 734496 - DNA, 13 bp, C. elegans
ttcagttttctat

SEQ ID NO: 734497 - DNA, 13 bp, C. elegans
ttcagttttgaac

SEQ ID NO: 734498 - DNA, 13 bp, C. elegans
ttcagttttgatt

SEQ ID NO: 734499 - DNA, 13 bp, C. elegans
ttcagttttggca

SEQ ID NO: 734500 - DNA, 13 bp, C. elegans
ttcagtttttaat

SEQ ID NO: 734501 - DNA, 13 bp, C. elegans
ttcagtttttcaa

SEQ ID NO: 734502 - DNA, 13 bp, C. elegans
ttcagttttttaa

SEQ ID NO: 734503 - DNA, 13 bp, C. elegans
ttcataaaaaact

SEQ ID NO: 734504 - DNA, 13 bp, C. elegans
ttcataaaacata

SEQ ID NO: 734505 - DNA, 13 bp, C. elegans
ttcataaaactct

SEQ ID NO: 734506 - DNA, 13 bp, C. elegans
ttcataaaatgtt

SEQ ID NO: 734507 - DNA, 13 bp, C. elegans
ttcataaactgat

SEQ ID NO: 734508 - DNA, 13 bp, C. elegans
ttcataaacttca

SEQ ID NO: 734509 - DNA, 13 bp, C. elegans
ttcataaagttta

SEQ ID NO: 734510 - DNA, 13 bp, C. elegans
ttcataaatcata

SEQ ID NO: 734511 - DNA, 13 bp, C. elegans
ttcataaatcttt

SEQ ID NO: 734512 - DNA, 13 bp, C. elegans
ttcataaattatc

SEQ ID NO: 734513 - DNA, 13 bp, C. elegans
ttcataaattcag

SEQ ID NO: 734514 - DNA, 13 bp, C. elegans
ttcataaatttca

SEQ ID NO: 734515 - DNA, 13 bp, C. elegans
ttcataacagttt

SEQ ID NO: 734516 - DNA, 13 bp, C. elegans
ttcataacgtttt

SEQ ID NO: 734517 - DNA, 14 bp, C. elegans
ttcataagtgcaaa

SEQ ID NO: 734518 - DNA, 13 bp, C. elegans
ttcataagtttga

SEQ ID NO: 734519 - DNA, 13 bp, C. elegans
ttcataatgaaac

SEQ ID NO: 734520 - DNA, 13 bp, C. elegans
ttcataattattc

SEQ ID NO: 734521 - DNA, 13 bp, C. elegans
ttcataattcaat

SEQ ID NO: 734522 - DNA, 13 bp, C. elegans
ttcataattgttt

SEQ ID NO: 734523 - DNA, 13 bp, C. elegans
ttcataatttctg

SEQ ID NO: 734524 - DNA, 13 bp, C. elegans
ttcataatttgat

SEQ ID NO: 734525 - DNA, 13 bp, C. elegans
ttcataattttcg

SEQ ID NO: 734526 - DNA, 13 bp, C. elegans
ttcataattttga

SEQ ID NO: 734527 - DNA, 13 bp, C. elegans
ttcataatttttg

SEQ ID NO: 734528 - DNA, 13 bp, C. elegans
ttcatacaaaaat

SEQ ID NO: 734529 - DNA, 13 bp, C. elegans
ttcatacaaaatt

SEQ ID NO: 734530 - DNA, 13 bp, C. elegans
ttcatacattcaa

SEQ ID NO: 734531 - DNA, 13 bp, C. elegans
ttcatactatttg

SEQ ID NO: 734532 - DNA, 13 bp, C. elegans
ttcatacttttcc

SEQ ID NO: 734533 - DNA, 13 bp, C. elegans
ttcatactttttg

SEQ ID NO: 734534 - DNA, 13 bp, C. elegans
ttcatagaaaatc

SEQ ID NO: 734535 - DNA, 13 bp, C. elegans
ttcatagtttcat

SEQ ID NO: 734536 - DNA, 13 bp, C. elegans
ttcatagtttttc

SEQ ID NO: 734537 - DNA, 13 bp, C. elegans
ttcatatacatat

SEQ ID NO: 734538 - DNA, 14 bp, C. elegans
ttcatatacatata

SEQ ID NO: 734539 - DNA, 13 bp, C. elegans
ttcatatacattt

SEQ ID NO: 734540 - DNA, 13 bp, C. elegans
ttcatatatttca

SEQ ID NO: 734541 - DNA, 13 bp, C. elegans
ttcatatcaaaaa

SEQ ID NO: 734542 - DNA, 13 bp, C. elegans
ttcatatccaaaa

SEQ ID NO: 734543 - DNA, 13 bp, C. elegans
ttcatatccaatt

SEQ ID NO: 734544 - DNA, 13 bp, C. elegans
ttcatatcttgaa

SEQ ID NO: 734545 - DNA, 13 bp, C. elegans
ttcatatgaaaaa

SEQ ID NO: 734546 - DNA, 13 bp, C. elegans
ttcatatgatgtt

SEQ ID NO: 734547 - DNA, 13 bp, C. elegans
ttcatatgatttg

SEQ ID NO: 734548 - DNA, 13 bp, C. elegans
ttcatatgatttt

SEQ ID NO: 734549 - DNA, 13 bp, C. elegans
ttcatatgttttc

SEQ ID NO: 734550 - DNA, 13 bp, C. elegans
ttcatattaaaac

SEQ ID NO: 734551 - DNA, 13 bp, C. elegans
ttcatattacaaa

SEQ ID NO: 734552 - DNA, 13 bp, C. elegans
ttcatattatcaa

SEQ ID NO: 734553 - DNA, 13 bp, C. elegans
ttcatattcaatt

SEQ ID NO: 734554 - DNA, 13 bp, C. elegans
ttcatattcattg

SEQ ID NO: 734555 - DNA, 13 bp, C. elegans
ttcatattgaatt

SEQ ID NO: 734556 - DNA, 13 bp, C. elegans
ttcatatttctaa

SEQ ID NO: 734557 - DNA, 13 bp, C. elegans
ttcatatttgaag

SEQ ID NO: 734558 - DNA, 13 bp, C. elegans
ttcatattttagg

SEQ ID NO: 734559 - DNA, 13 bp, C. elegans
ttcatattttcag

SEQ ID NO: 734560 - DNA, 13 bp, C. elegans
ttcatattttgca

SEQ ID NO: 734561 - DNA, 13 bp, C. elegans
ttcatatttttga

SEQ ID NO: 734562 - DNA, 13 bp, C. elegans
ttcatcaaaaaat

SEQ ID NO: 734563 - DNA, 13 bp, C. elegans
ttcatcaaaaata

SEQ ID NO: 734564 - DNA, 13 bp, C. elegans
ttcatcaaaactt

SEQ ID NO: 734565 - DNA, 13 bp, C. elegans
ttcatcaaaatca

SEQ ID NO: 734566 - DNA, 13 bp, C. elegans
ttcatcaaaatta

SEQ ID NO: 734567 - DNA, 13 bp, C. elegans
ttcatcaaagttt

SEQ ID NO: 734568 - DNA, 13 bp, C. elegans
ttcatcaaattat

SEQ ID NO: 734569 - DNA, 13 bp, C. elegans
ttcatcaaattcg

SEQ ID NO: 734570 - DNA, 13 bp, C. elegans
ttcatcaaattct

SEQ ID NO: 734571 - DNA, 14 bp, C. elegans
ttcatcaaattttg

SEQ ID NO: 734572 - DNA, 13 bp, C. elegans
ttcatcaacaaat

SEQ ID NO: 734573 - DNA, 13 bp, C. elegans
ttcatcaactttt

SEQ ID NO: 734574 - DNA, 13 bp, C. elegans
ttcatcaattatt

SEQ ID NO: 734575 - DNA, 13 bp, C. elegans
ttcatcaattcat

SEQ ID NO: 734576 - DNA, 13 bp, C. elegans
ttcatcaattgaa

SEQ ID NO: 734577 - DNA, 13 bp, C. elegans
ttcatcaatttcc

SEQ ID NO: 734578 - DNA, 13 bp, C. elegans
ttcatcaattttc

SEQ ID NO: 734579 - DNA, 13 bp, C. elegans
ttcatcacatttc

SEQ ID NO: 734580 - DNA, 13 bp, C. elegans
ttcatcaccaaaa

SEQ ID NO: 734581 - DNA, 13 bp, C. elegans
ttcatcagatttt

SEQ ID NO: 734582 - DNA, 13 bp, C. elegans
ttcatcagttgaa

SEQ ID NO: 734583 - DNA, 13 bp, C. elegans
ttcatcagttttt

SEQ ID NO: 734584 - DNA, 13 bp, C. elegans
ttcatcatgaaat

SEQ ID NO: 734585 - DNA, 13 bp, C. elegans
ttcatcattattc

SEQ ID NO: 734586 - DNA, 13 bp, C. elegans
ttcatcatttttg

SEQ ID NO: 734587 - DNA, 13 bp, C. elegans
ttcatccaaaaat

SEQ ID NO: 734588 - DNA, 13 bp, C. elegans
ttcatccaaaatt

SEQ ID NO: 734589 - DNA, 13 bp, C. elegans
ttcatccccaaaa

SEQ ID NO: 734590 - DNA, 13 bp, C. elegans
ttcatcgaaaaac

SEQ ID NO: 734591 - DNA, 13 bp, C. elegans
ttcatcgaatttc

SEQ ID NO: 734592 - DNA, 13 bp, C. elegans
ttcatcgactttt

SEQ ID NO: 734593 - DNA, 13 bp, C. elegans
ttcatcgagtttt

SEQ ID NO: 734594 - DNA, 13 bp, C. elegans
ttcatcgattatt

SEQ ID NO: 734595 - DNA, 13 bp, C. elegans
ttcatcgatttct

SEQ ID NO: 734596 - DNA, 13 bp, C. elegans
ttcatcgttttct

SEQ ID NO: 734597 - DNA, 13 bp, C. elegans
ttcatcgtttttc

SEQ ID NO: 734598 - DNA, 13 bp, C. elegans
ttcatctaaaaaa

SEQ ID NO: 734599 - DNA, 13 bp, C. elegans
ttcatctaaattt

SEQ ID NO: 734600 - DNA, 13 bp, C. elegans
ttcatctaccgtt

SEQ ID NO: 734601 - DNA, 13 bp, C. elegans
ttcatctgaaaat

SEQ ID NO: 734602 - DNA, 13 bp, C. elegans
ttcatctgaaatt

SEQ ID NO: 734603 - DNA, 13 bp, C. elegans
ttcatcttcatct

SEQ ID NO: 734604 - DNA, 13 bp, C. elegans
ttcatcttccatt

SEQ ID NO: 734605 - DNA, 13 bp, C. elegans
ttcatcttttcaa

SEQ ID NO: 734606 - DNA, 13 bp, C. elegans
ttcatcttttgaa

SEQ ID NO: 734607 - DNA, 13 bp, C. elegans
ttcatctttttcg

SEQ ID NO: 734608 - DNA, 13 bp, C. elegans
ttcatgaaaaata

SEQ ID NO: 734609 - DNA, 13 bp, C. elegans
ttcatgaaaacaa

SEQ ID NO: 734610 - DNA, 13 bp, C. elegans
ttcatgaaaactg

SEQ ID NO: 734611 - DNA, 13 bp, C. elegans
ttcatgaaaactt

SEQ ID NO: 734612 - DNA, 13 bp, C. elegans
ttcatgaaaatca

SEQ ID NO: 734613 - DNA, 13 bp, C. elegans
ttcatgaaacaaa

SEQ ID NO: 734614 - DNA, 13 bp, C. elegans
ttcatgaaacttt

SEQ ID NO: 734615 - DNA, 13 bp, C. elegans
ttcatgaaattaa

SEQ ID NO: 734616 - DNA, 13 bp, C. elegans
ttcatgaataaaa

SEQ ID NO: 734617 - DNA, 13 bp, C. elegans
ttcatgaattaat

SEQ ID NO: 734618 - DNA, 13 bp, C. elegans
ttcatgagaatgc

SEQ ID NO: 734619 - DNA, 13 bp, C. elegans
ttcatgatgaccc

SEQ ID NO: 734620 - DNA, 13 bp, C. elegans
ttcatgatttatt

SEQ ID NO: 734621 - DNA, 13 bp, C. elegans
ttcatgatttcat

SEQ ID NO: 734622 - DNA, 13 bp, C. elegans
ttcatgcactttt

SEQ ID NO: 734623 - DNA, 13 bp, C. elegans
ttcatggaaaaaa

SEQ ID NO: 734624 - DNA, 13 bp, C. elegans
ttcatggaatttt

SEQ ID NO: 734625 - DNA, 13 bp, C. elegans
ttcatggctcaat

SEQ ID NO: 734626 - DNA, 13 bp, C. elegans
ttcatggtgcatc

SEQ ID NO: 734627 - DNA, 13 bp, C. elegans
ttcatgtaaaaaa

SEQ ID NO: 734628 - DNA, 13 bp, C. elegans
ttcatgtcaaaat

SEQ ID NO: 734629 - DNA, 13 bp, C. elegans
ttcatgtcaaatt

SEQ ID NO: 734630 - DNA, 13 bp, C. elegans
ttcatgtgatttt

SEQ ID NO: 734631 - DNA, 13 bp, C. elegans
ttcatgttaattt

SEQ ID NO: 734632 - DNA, 13 bp, C. elegans
ttcatgttcaaat

SEQ ID NO: 734633 - DNA, 13 bp, C. elegans
ttcatgttccaaa

SEQ ID NO: 734634 - DNA, 13 bp, C. elegans
ttcatgttgattt

SEQ ID NO: 734635 - DNA, 13 bp, C. elegans
ttcatgtttcaat

SEQ ID NO: 734636 - DNA, 13 bp, C. elegans
ttcatgttttata

SEQ ID NO: 734637 - DNA, 13 bp, C. elegans
ttcatgttttcaa

SEQ ID NO: 734638 - DNA, 13 bp, C. elegans
ttcatgttttcca

SEQ ID NO: 734639 - DNA, 13 bp, C. elegans
ttcatgttttcgt

SEQ ID NO: 734640 - DNA, 13 bp, C. elegans
ttcatgttttctc

SEQ ID NO: 734641 - DNA, 13 bp, C. elegans
ttcatgtttttag

SEQ ID NO: 734642 - DNA, 13 bp, C. elegans
ttcattaaaaatg

SEQ ID NO: 734643 - DNA, 13 bp, C. elegans
ttcattaaaacat

SEQ ID NO: 734644 - DNA, 13 bp, C. elegans
ttcattaatgaaa

SEQ ID NO: 734645 - DNA, 13 bp, C. elegans
ttcattaatttga

SEQ ID NO: 734646 - DNA, 13 bp, C. elegans
ttcattaccaaaa

SEQ ID NO: 734647 - DNA, 13 bp, C. elegans
ttcattagactca

SEQ ID NO: 734648 - DNA, 13 bp, C. elegans
ttcattatcaatt

SEQ ID NO: 734649 - DNA, 13 bp, C. elegans
ttcattattcaaa

SEQ ID NO: 734650 - DNA, 13 bp, C. elegans
ttcattatttcac

SEQ ID NO: 734651 - DNA, 13 bp, C. elegans
ttcattcaaaaaa

SEQ ID NO: 734652 - DNA, 13 bp, C. elegans
ttcattcaaaagt

SEQ ID NO: 734653 - DNA, 13 bp, C. elegans
ttcattcaaaata

SEQ ID NO: 734654 - DNA, 13 bp, C. elegans
ttcattcaaaatt

SEQ ID NO: 734655 - DNA, 13 bp, C. elegans
ttcattcaacaat

SEQ ID NO: 734656 - DNA, 13 bp, C. elegans
ttcattcaacatt

SEQ ID NO: 734657 - DNA, 13 bp, C. elegans
ttcattcaataaa

SEQ ID NO: 734658 - DNA, 13 bp, C. elegans
ttcattcaattca

SEQ ID NO: 734659 - DNA, 13 bp, C. elegans
ttcattcaatttc

SEQ ID NO: 734660 - DNA, 13 bp, C. elegans
ttcattcacaaat

SEQ ID NO: 734661 - DNA, 13 bp, C. elegans
ttcattcagattt

SEQ ID NO: 734662 - DNA, 13 bp, C. elegans
ttcattcagtttt

SEQ ID NO: 734663 - DNA, 13 bp, C. elegans
ttcattcatatta

SEQ ID NO: 734664 - DNA, 13 bp, C. elegans
ttcattcatcaaa

SEQ ID NO: 734665 - DNA, 13 bp, C. elegans
ttcattcatcatt

SEQ ID NO: 734666 - DNA, 13 bp, C. elegans
ttcattcattcaa

SEQ ID NO: 734667 - DNA, 13 bp, C. elegans
ttcattcattgaa

SEQ ID NO: 734668 - DNA, 13 bp, C. elegans
ttcattcatttcc

SEQ ID NO: 734669 - DNA, 13 bp, C. elegans
ttcattcattttg

SEQ ID NO: 734670 - DNA, 13 bp, C. elegans
ttcattccaaaaa

SEQ ID NO: 734671 - DNA, 13 bp, C. elegans
ttcattccaattt

SEQ ID NO: 734672 - DNA, 13 bp, C. elegans
ttcattcgaaaaa

SEQ ID NO: 734673 - DNA, 13 bp, C. elegans
ttcattcgttttc

SEQ ID NO: 734674 - DNA, 13 bp, C. elegans
ttcattcttaaaa

SEQ ID NO: 734675 - DNA, 13 bp, C. elegans
ttcattcttcaaa

SEQ ID NO: 734676 - DNA, 13 bp, C. elegans
ttcattcttcaat

SEQ ID NO: 734677 - DNA, 13 bp, C. elegans
ttcattcttgaaa

SEQ ID NO: 734678 - DNA, 13 bp, C. elegans
ttcattgaaaaat

SEQ ID NO: 734679 - DNA, 13 bp, C. elegans
ttcattgaaaact

SEQ ID NO: 734680 - DNA, 13 bp, C. elegans
ttcattgaaaagt

SEQ ID NO: 734681 - DNA, 13 bp, C. elegans
ttcattgaaaata

SEQ ID NO: 734682 - DNA, 13 bp, C. elegans
ttcattgaaaatt

SEQ ID NO: 734683 - DNA, 13 bp, C. elegans
ttcattgaaactt

SEQ ID NO: 734684 - DNA, 13 bp, C. elegans
ttcattgaaattc

SEQ ID NO: 734685 - DNA, 13 bp, C. elegans
ttcattgaaattt

SEQ ID NO: 734686 - DNA, 13 bp, C. elegans
ttcattgaagaaa

SEQ ID NO: 734687 - DNA, 13 bp, C. elegans
ttcattgaattct

SEQ ID NO: 734688 - DNA, 13 bp, C. elegans
ttcattgaatttc

SEQ ID NO: 734689 - DNA, 13 bp, C. elegans
ttcattgacaaaa

SEQ ID NO: 734690 - DNA, 13 bp, C. elegans
ttcattgataaat

SEQ ID NO: 734691 - DNA, 13 bp, C. elegans
ttcattgatactt

SEQ ID NO: 734692 - DNA, 13 bp, C. elegans
ttcattgatgttt

SEQ ID NO: 734693 - DNA, 13 bp, C. elegans
ttcattgatttca

SEQ ID NO: 734694 - DNA, 13 bp, C. elegans
ttcattgatttct

SEQ ID NO: 734695 - DNA, 13 bp, C. elegans
ttcattgatttta

SEQ ID NO: 734696 - DNA, 13 bp, C. elegans
ttcattggaaatt

SEQ ID NO: 734697 - DNA, 13 bp, C. elegans
ttcattggagcta

SEQ ID NO: 734698 - DNA, 13 bp, C. elegans
ttcattgtaaaat

SEQ ID NO: 734699 - DNA, 13 bp, C. elegans
ttcattgtgattt

SEQ ID NO: 734700 - DNA, 13 bp, C. elegans
ttcattgttattg

SEQ ID NO: 734701 - DNA, 13 bp, C. elegans
ttcatttaaaaac

SEQ ID NO: 734702 - DNA, 13 bp, C. elegans
ttcatttagaaaa

SEQ ID NO: 734703 - DNA, 13 bp, C. elegans
ttcatttattcca

SEQ ID NO: 734704 - DNA, 13 bp, C. elegans
ttcatttcaaaaa

SEQ ID NO: 734705 - DNA, 13 bp, C. elegans
ttcatttcaaaca

SEQ ID NO: 734706 - DNA, 13 bp, C. elegans
ttcatttcaaatt

SEQ ID NO: 734707 - DNA, 13 bp, C. elegans
ttcatttcaattc

SEQ ID NO: 734708 - DNA, 13 bp, C. elegans
ttcatttcacaca

SEQ ID NO: 734709 - DNA, 13 bp, C. elegans
ttcatttcataaa

SEQ ID NO: 734710 - DNA, 13 bp, C. elegans
ttcatttcatcaa

SEQ ID NO: 734711 - DNA, 13 bp, C. elegans
ttcatttcatcca

SEQ ID NO: 734712 - DNA, 13 bp, C. elegans
ttcatttcattgt

SEQ ID NO: 734713 - DNA, 13 bp, C. elegans
ttcatttccaaaa

SEQ ID NO: 734714 - DNA, 13 bp, C. elegans
ttcatttcgaaaa

SEQ ID NO: 734715 - DNA, 13 bp, C. elegans
ttcatttcgattt

SEQ ID NO: 734716 - DNA, 13 bp, C. elegans
ttcatttctaaaa

SEQ ID NO: 734717 - DNA, 13 bp, C. elegans
ttcatttctcact

SEQ ID NO: 734718 - DNA, 13 bp, C. elegans
ttcatttctccaa

SEQ ID NO: 734719 - DNA, 13 bp, C. elegans
ttcatttctctaa

SEQ ID NO: 734720 - DNA, 13 bp, C. elegans
ttcatttcttcaa

SEQ ID NO: 734721 - DNA, 13 bp, C. elegans
ttcatttcttgat

SEQ ID NO: 734722 - DNA, 13 bp, C. elegans
ttcatttgaaaac

SEQ ID NO: 734723 - DNA, 13 bp, C. elegans
ttcatttgaaaat

SEQ ID NO: 734724 - DNA, 13 bp, C. elegans
ttcatttgaaata

SEQ ID NO: 734725 - DNA, 13 bp, C. elegans
ttcatttgaattt

SEQ ID NO: 734726 - DNA, 13 bp, C. elegans
ttcatttgagttt

SEQ ID NO: 734727 - DNA, 13 bp, C. elegans
ttcatttgataaa

SEQ ID NO: 734728 - DNA, 13 bp, C. elegans
ttcatttgattat

SEQ ID NO: 734729 - DNA, 13 bp, C. elegans
ttcatttgcactg

SEQ ID NO: 734730 - DNA, 13 bp, C. elegans
ttcatttggaaaa

SEQ ID NO: 734731 - DNA, 13 bp, C. elegans
ttcatttggagaa

SEQ ID NO: 734732 - DNA, 13 bp, C. elegans
ttcatttgtaaaa

SEQ ID NO: 734733 - DNA, 13 bp, C. elegans
ttcatttgtgaat

SEQ ID NO: 734734 - DNA, 13 bp, C. elegans
ttcattttaacaa

SEQ ID NO: 734735 - DNA, 13 bp, C. elegans
ttcattttaatac

SEQ ID NO: 734736 - DNA, 13 bp, C. elegans
ttcattttaatga

SEQ ID NO: 734737 - DNA, 13 bp, C. elegans
ttcattttataca

SEQ ID NO: 734738 - DNA, 13 bp, C. elegans
ttcattttcaaat

SEQ ID NO: 734739 - DNA, 13 bp, C. elegans
ttcattttcaaca

SEQ ID NO: 734740 - DNA, 14 bp, C. elegans
ttcattttcaatat

SEQ ID NO: 734741 - DNA, 13 bp, C. elegans
ttcattttcatga

SEQ ID NO: 734742 - DNA, 13 bp, C. elegans
ttcattttcgaaa

SEQ ID NO: 734743 - DNA, 13 bp, C. elegans
ttcattttctaaa

SEQ ID NO: 734744 - DNA, 13 bp, C. elegans
ttcattttctaca

SEQ ID NO: 734745 - DNA, 13 bp, C. elegans
ttcattttctgca

SEQ ID NO: 734746 - DNA, 13 bp, C. elegans
ttcattttgagtt

SEQ ID NO: 734747 - DNA, 13 bp, C. elegans
ttcattttgatat

SEQ ID NO: 734748 - DNA, 13 bp, C. elegans
ttcattttgcaaa

SEQ ID NO: 734749 - DNA, 13 bp, C. elegans
ttcattttgttca

SEQ ID NO: 734750 - DNA, 13 bp, C. elegans
ttcatttttacag

SEQ ID NO: 734751 - DNA, 13 bp, C. elegans
ttcatttttacgc

SEQ ID NO: 734752 - DNA, 13 bp, C. elegans
ttcatttttatga

SEQ ID NO: 734753 - DNA, 13 bp, C. elegans
ttcatttttcaaa

SEQ ID NO: 734754 - DNA, 13 bp, C. elegans
ttcatttttcacg

SEQ ID NO: 734755 - DNA, 13 bp, C. elegans
ttcatttttccaa

SEQ ID NO: 734756 - DNA, 13 bp, C. elegans
ttcatttttcgga

SEQ ID NO: 734757 - DNA, 13 bp, C. elegans
ttcatttttcggc

SEQ ID NO: 734758 - DNA, 13 bp, C. elegans
ttcatttttcgtc

SEQ ID NO: 734759 - DNA, 13 bp, C. elegans
ttcatttttgaaa

SEQ ID NO: 734760 - DNA, 13 bp, C. elegans
ttcatttttgcat

SEQ ID NO: 734761 - DNA, 13 bp, C. elegans
ttcatttttggaa

SEQ ID NO: 734762 - DNA, 13 bp, C. elegans
ttcattttttcgg

SEQ ID NO: 734763 - DNA, 13 bp, C. elegans
ttccaaaaaaaag

SEQ ID NO: 734764 - DNA, 13 bp, C. elegans
ttccaaaaaaacc

SEQ ID NO: 734765 - DNA, 13 bp, C. elegans
ttccaaaaaaatc

SEQ ID NO: 734766 - DNA, 13 bp, C. elegans
ttccaaaaaaccg

SEQ ID NO: 734767 - DNA, 13 bp, C. elegans
ttccaaaaaactt

SEQ ID NO: 734768 - DNA, 13 bp, C. elegans
ttccaaaaaagtt

SEQ ID NO: 734769 - DNA, 13 bp, C. elegans
ttccaaaaaatat

SEQ ID NO: 734770 - DNA, 13 bp, C. elegans
ttccaaaaaatct

SEQ ID NO: 734771 - DNA, 13 bp, C. elegans
ttccaaaaaatga

SEQ ID NO: 734772 - DNA, 13 bp, C. elegans
ttccaaaaaatgt

SEQ ID NO: 734773 - DNA, 14 bp, C. elegans
ttccaaaaaatttt

SEQ ID NO: 734774 - DNA, 13 bp, C. elegans
ttccaaaaacata

SEQ ID NO: 734775 - DNA, 13 bp, C. elegans
ttccaaaaacgaa

SEQ ID NO: 734776 - DNA, 13 bp, C. elegans
ttccaaaaactac

SEQ ID NO: 734777 - DNA, 13 bp, C. elegans
ttccaaaaactat

SEQ ID NO: 734778 - DNA, 13 bp, C. elegans
ttccaaaaactgt

SEQ ID NO: 734779 - DNA, 13 bp, C. elegans
ttccaaaaagaaa

SEQ ID NO: 734780 - DNA, 13 bp, C. elegans
ttccaaaaagctc

SEQ ID NO: 734781 - DNA, 13 bp, C. elegans
ttccaaaaagctt

SEQ ID NO: 734782 - DNA, 13 bp, C. elegans
ttccaaaaagtgc

SEQ ID NO: 734783 - DNA, 13 bp, C. elegans
ttccaaaaagtta

SEQ ID NO: 734784 - DNA, 13 bp, C. elegans
ttccaaaaagttt

SEQ ID NO: 734785 - DNA, 13 bp, C. elegans
ttccaaaaatatt

SEQ ID NO: 734786 - DNA, 13 bp, C. elegans
ttccaaaaatcaa

SEQ ID NO: 734787 - DNA, 13 bp, C. elegans
ttccaaaaatcat

SEQ ID NO: 734788 - DNA, 13 bp, C. elegans
ttccaaaaatcga

SEQ ID NO: 734789 - DNA, 13 bp, C. elegans
ttccaaaaatctc

SEQ ID NO: 734790 - DNA, 13 bp, C. elegans
ttccaaaaatgaa

SEQ ID NO: 734791 - DNA, 13 bp, C. elegans
ttccaaaaatgtg

SEQ ID NO: 734792 - DNA, 13 bp, C. elegans
ttccaaaaattat

SEQ ID NO: 734793 - DNA, 13 bp, C. elegans
ttccaaaaatttc

SEQ ID NO: 734794 - DNA, 13 bp, C. elegans
ttccaaaaatttg

SEQ ID NO: 734795 - DNA, 13 bp, C. elegans
ttccaaaaatttt

SEQ ID NO: 734796 - DNA, 13 bp, C. elegans
ttccaaaacatcc

SEQ ID NO: 734797 - DNA, 13 bp, C. elegans
ttccaaaacattt

SEQ ID NO: 734798 - DNA, 13 bp, C. elegans
ttccaaaaccttt

SEQ ID NO: 734799 - DNA, 13 bp, C. elegans
ttccaaaactaca

SEQ ID NO: 734800 - DNA, 13 bp, C. elegans
ttccaaaactcaa

SEQ ID NO: 734801 - DNA, 13 bp, C. elegans
ttccaaaactgtt

SEQ ID NO: 734802 - DNA, 13 bp, C. elegans
ttccaaaacttgt

SEQ ID NO: 734803 - DNA, 13 bp, C. elegans
ttccaaaactttc

SEQ ID NO: 734804 - DNA, 13 bp, C. elegans
ttccaaaactttt

SEQ ID NO: 734805 - DNA, 13 bp, C. elegans
ttccaaaagaaat

SEQ ID NO: 734806 - DNA, 13 bp, C. elegans
ttccaaaagattt

SEQ ID NO: 734807 - DNA, 13 bp, C. elegans
ttccaaaagcttt

SEQ ID NO: 734808 - DNA, 13 bp, C. elegans
ttccaaaagttct

SEQ ID NO: 734809 - DNA, 13 bp, C. elegans
ttccaaaagtttt

SEQ ID NO: 734810 - DNA, 13 bp, C. elegans
ttccaaaatatta

SEQ ID NO: 734811 - DNA, 13 bp, C. elegans
ttccaaaatattc

SEQ ID NO: 734812 - DNA, 13 bp, C. elegans
ttccaaaatattt

SEQ ID NO: 734813 - DNA, 13 bp, C. elegans
ttccaaaatcatg

SEQ ID NO: 734814 - DNA, 13 bp, C. elegans
ttccaaaatctca

SEQ ID NO: 734815 - DNA, 13 bp, C. elegans
ttccaaaatctgt

SEQ ID NO: 734816 - DNA, 13 bp, C. elegans
ttccaaaatcttt

SEQ ID NO: 734817 - DNA, 13 bp, C. elegans
ttccaaaatgaga

SEQ ID NO: 734818 - DNA, 13 bp, C. elegans
ttccaaaatgctc

SEQ ID NO: 734819 - DNA, 13 bp, C. elegans
ttccaaaatggaa

SEQ ID NO: 734820 - DNA, 13 bp, C. elegans
ttccaaaatgtgc

SEQ ID NO: 734821 - DNA, 13 bp, C. elegans
ttccaaaattatc

SEQ ID NO: 734822 - DNA, 16 bp, C. elegans
ttccaaaattatgagt

SEQ ID NO: 734823 - DNA, 13 bp, C. elegans
ttccaaaattctt

SEQ ID NO: 734824 - DNA, 13 bp, C. elegans
ttccaaaattgag

SEQ ID NO: 734825 - DNA, 14 bp, C. elegans
ttccaaaatttcat

SEQ ID NO: 734826 - DNA, 13 bp, C. elegans
ttccaaaatttga

SEQ ID NO: 734827 - DNA, 13 bp, C. elegans
ttccaaacaacca

SEQ ID NO: 734828 - DNA, 13 bp, C. elegans
ttccaaacaacta

SEQ ID NO: 734829 - DNA, 13 bp, C. elegans
ttccaaacaattc

SEQ ID NO: 734830 - DNA, 13 bp, C. elegans
ttccaaacacttt

SEQ ID NO: 734831 - DNA, 13 bp, C. elegans
ttccaaactcaaa

SEQ ID NO: 734832 - DNA, 13 bp, C. elegans
ttccaaacttcca

SEQ ID NO: 734833 - DNA, 13 bp, C. elegans
ttccaaactttca

SEQ ID NO: 734834 - DNA, 13 bp, C. elegans
ttccaaactttta

SEQ ID NO: 734835 - DNA, 13 bp, C. elegans
ttccaaacttttc

SEQ ID NO: 734836 - DNA, 13 bp, C. elegans
ttccaaagaaaaa

SEQ ID NO: 734837 - DNA, 13 bp, C. elegans
ttccaaagaaaat

SEQ ID NO: 734838 - DNA, 13 bp, C. elegans
ttccaaagatttt

SEQ ID NO: 734839 - DNA, 13 bp, C. elegans
ttccaaagttatt

SEQ ID NO: 734840 - DNA, 13 bp, C. elegans
ttccaaagttttc

SEQ ID NO: 734841 - DNA, 13 bp, C. elegans
ttccaaatattaa

SEQ ID NO: 734842 - DNA, 13 bp, C. elegans
ttccaaatattat

SEQ ID NO: 734843 - DNA, 13 bp, C. elegans
ttccaaatattca

SEQ ID NO: 734844 - DNA, 13 bp, C. elegans
ttccaaatattct

SEQ ID NO: 734845 - DNA, 13 bp, C. elegans
ttccaaatattta

SEQ ID NO: 734846 - DNA, 13 bp, C. elegans
ttccaaatatttc

SEQ ID NO: 734847 - DNA, 13 bp, C. elegans
ttccaaatatttt

SEQ ID NO: 734848 - DNA, 13 bp, C. elegans
ttccaaatccaaa

SEQ ID NO: 734849 - DNA, 13 bp, C. elegans
ttccaaatctcaa

SEQ ID NO: 734850 - DNA, 13 bp, C. elegans
ttccaaatgaaaa

SEQ ID NO: 734851 - DNA, 13 bp, C. elegans
ttccaaatgtttc

SEQ ID NO: 734852 - DNA, 13 bp, C. elegans
ttccaaatgtttg

SEQ ID NO: 734853 - DNA, 13 bp, C. elegans
ttccaaattcgaa

SEQ ID NO: 734854 - DNA, 13 bp, C. elegans
ttccaaattggaa

SEQ ID NO: 734855 - DNA, 13 bp, C. elegans
ttccaaattgttt

SEQ ID NO: 734856 - DNA, 13 bp, C. elegans
ttccaaatttaat

SEQ ID NO: 734857 - DNA, 13 bp, C. elegans
ttccaaatttcca

SEQ ID NO: 734858 - DNA, 13 bp, C. elegans
ttccaaatttccc

SEQ ID NO: 734859 - DNA, 13 bp, C. elegans
ttccaaatttctt

SEQ ID NO: 734860 - DNA, 13 bp, C. elegans
ttccaaatttgat

SEQ ID NO: 734861 - DNA, 13 bp, C. elegans
ttccaaattttat

SEQ ID NO: 734862 - DNA, 13 bp, C. elegans
ttccaaattttca

SEQ ID NO: 734863 - DNA, 13 bp, C. elegans
ttccaaattttga

SEQ ID NO: 734864 - DNA, 13 bp, C. elegans
ttccaaattttta

SEQ ID NO: 734865 - DNA, 13 bp, C. elegans
ttccaacaaatcg

SEQ ID NO: 734866 - DNA, 13 bp, C. elegans
ttccaacaagaaa

SEQ ID NO: 734867 - DNA, 13 bp, C. elegans
ttccaacaataaa

SEQ ID NO: 734868 - DNA, 13 bp, C. elegans
ttccaacactttt

SEQ ID NO: 734869 - DNA, 13 bp, C. elegans
ttccaacatttct

SEQ ID NO: 734870 - DNA, 13 bp, C. elegans
ttccaacatttta

SEQ ID NO: 734871 - DNA, 13 bp, C. elegans
ttccaaccaaaaa

SEQ ID NO: 734872 - DNA, 13 bp, C. elegans
ttccaaccatttt

SEQ ID NO: 734873 - DNA, 13 bp, C. elegans
ttccaacgaaaat

SEQ ID NO: 734874 - DNA, 13 bp, C. elegans
ttccaacgttttt

SEQ ID NO: 734875 - DNA, 13 bp, C. elegans
ttccaactatttc

SEQ ID NO: 734876 - DNA, 13 bp, C. elegans
ttccaactcttcc

SEQ ID NO: 734877 - DNA, 13 bp, C. elegans
ttccaacttcaaa

SEQ ID NO: 734878 - DNA, 13 bp, C. elegans
ttccaacttctac

SEQ ID NO: 734879 - DNA, 13 bp, C. elegans
ttccaacttctca

SEQ ID NO: 734880 - DNA, 13 bp, C. elegans
ttccaacttctcg

SEQ ID NO: 734881 - DNA, 13 bp, C. elegans
ttccaactttcaa

SEQ ID NO: 734882 - DNA, 13 bp, C. elegans
ttccaactttctc

SEQ ID NO: 734883 - DNA, 13 bp, C. elegans
ttccaacttttct

SEQ ID NO: 734884 - DNA, 13 bp, C. elegans
ttccaagaaaaat

SEQ ID NO: 734885 - DNA, 13 bp, C. elegans
ttccaagaaaata

SEQ ID NO: 734886 - DNA, 13 bp, C. elegans
ttccaagaagttt

SEQ ID NO: 734887 - DNA, 13 bp, C. elegans
ttccaagaataca

SEQ ID NO: 734888 - DNA, 13 bp, C. elegans
ttccaagaattaa

SEQ ID NO: 734889 - DNA, 13 bp, C. elegans
ttccaagaatttt

SEQ ID NO: 734890 - DNA, 13 bp, C. elegans
ttccaagagtatt

SEQ ID NO: 734891 - DNA, 13 bp, C. elegans
ttccaagtgtttt

SEQ ID NO: 734892 - DNA, 13 bp, C. elegans
ttccaagtttcca

SEQ ID NO: 734893 - DNA, 13 bp, C. elegans
ttccaagttttga

SEQ ID NO: 734894 - DNA, 13 bp, C. elegans
ttccaagttttgt

SEQ ID NO: 734895 - DNA, 13 bp, C. elegans
ttccaagtttttt

SEQ ID NO: 734896 - DNA, 13 bp, C. elegans
ttccaataaaaat

SEQ ID NO: 734897 - DNA, 13 bp, C. elegans
ttccaataaactt

SEQ ID NO: 734898 - DNA, 13 bp, C. elegans
ttccaataaatat

SEQ ID NO: 734899 - DNA, 13 bp, C. elegans
ttccaataaattg

SEQ ID NO: 734900 - DNA, 13 bp, C. elegans
ttccaataatttc

SEQ ID NO: 734901 - DNA, 13 bp, C. elegans
ttccaataatttg

SEQ ID NO: 734902 - DNA, 13 bp, C. elegans
ttccaatattatt

SEQ ID NO: 734903 - DNA, 13 bp, C. elegans
ttccaatatttcc

SEQ ID NO: 734904 - DNA, 13 bp, C. elegans
ttccaatatttct

SEQ ID NO: 734905 - DNA, 13 bp, C. elegans
ttccaatcaaaat

SEQ ID NO: 734906 - DNA, 13 bp, C. elegans
ttccaatcaaata

SEQ ID NO: 734907 - DNA, 13 bp, C. elegans
ttccaatcaataa

SEQ ID NO: 734908 - DNA, 13 bp, C. elegans
ttccaatcatttt

SEQ ID NO: 734909 - DNA, 13 bp, C. elegans
ttccaatcgaaaa

SEQ ID NO: 734910 - DNA, 13 bp, C. elegans
ttccaatcttcaa

SEQ ID NO: 734911 - DNA, 13 bp, C. elegans
ttccaatgaaaat

SEQ ID NO: 734912 - DNA, 13 bp, C. elegans
ttccaatgaaatt

SEQ ID NO: 734913 - DNA, 13 bp, C. elegans
ttccaatgaattt

SEQ ID NO: 734914 - DNA, 13 bp, C. elegans
ttccaatgatttt

SEQ ID NO: 734915 - DNA, 13 bp, C. elegans
ttccaatgttcaa

SEQ ID NO: 734916 - DNA, 13 bp, C. elegans
ttccaatgtttta

SEQ ID NO: 734917 - DNA, 13 bp, C. elegans
ttccaattattat

SEQ ID NO: 734918 - DNA, 13 bp, C. elegans
ttccaattattca

SEQ ID NO: 734919 - DNA, 13 bp, C. elegans
ttccaattcaaaa

SEQ ID NO: 734920 - DNA, 13 bp, C. elegans
ttccaattccaaa

SEQ ID NO: 734921 - DNA, 13 bp, C. elegans
ttccaattcccat

SEQ ID NO: 734922 - DNA, 13 bp, C. elegans
ttccaattcttct

SEQ ID NO: 734923 - DNA, 13 bp, C. elegans
ttccaattgaaaa

SEQ ID NO: 734924 - DNA, 13 bp, C. elegans
ttccaattgaaat

SEQ ID NO: 734925 - DNA, 13 bp, C. elegans
ttccaattgtcaa

SEQ ID NO: 734926 - DNA, 13 bp, C. elegans
ttccaattgtttt

SEQ ID NO: 734927 - DNA, 13 bp, C. elegans
ttccaatttacaa

SEQ ID NO: 734928 - DNA, 13 bp, C. elegans
ttccaatttatca

SEQ ID NO: 734929 - DNA, 13 bp, C. elegans
ttccaatttattc

SEQ ID NO: 734930 - DNA, 13 bp, C. elegans
ttccaatttcaac

SEQ ID NO: 734931 - DNA, 13 bp, C. elegans
ttccaatttcact

SEQ ID NO: 734932 - DNA, 13 bp, C. elegans
ttccaatttcata

SEQ ID NO: 734933 - DNA, 13 bp, C. elegans
ttccaatttcatt

SEQ ID NO: 734934 - DNA, 13 bp, C. elegans
ttccaatttccaa

SEQ ID NO: 734935 - DNA, 13 bp, C. elegans
ttccaatttccag

SEQ ID NO: 734936 - DNA, 13 bp, C. elegans
ttccaatttccgg

SEQ ID NO: 734937 - DNA, 13 bp, C. elegans
ttccaatttcgaa

SEQ ID NO: 734938 - DNA, 13 bp, C. elegans
ttccaatttctat

SEQ ID NO: 734939 - DNA, 13 bp, C. elegans
ttccaatttctcc

SEQ ID NO: 734940 - DNA, 13 bp, C. elegans
ttccaatttcttc

SEQ ID NO: 734941 - DNA, 13 bp, C. elegans
ttccaatttgaat

SEQ ID NO: 734942 - DNA, 13 bp, C. elegans
ttccaatttgcaa

SEQ ID NO: 734943 - DNA, 13 bp, C. elegans
ttccaattttaat

SEQ ID NO: 734944 - DNA, 13 bp, C. elegans
ttccaattttaga

SEQ ID NO: 734945 - DNA, 13 bp, C. elegans
ttccaattttagt

SEQ ID NO: 734946 - DNA, 13 bp, C. elegans
ttccaattttccc

SEQ ID NO: 734947 - DNA, 13 bp, C. elegans
ttccaattttcga

SEQ ID NO: 734948 - DNA, 13 bp, C. elegans
ttccaattttcgt

SEQ ID NO: 734949 - DNA, 13 bp, C. elegans
ttccaattttcta

SEQ ID NO: 734950 - DNA, 13 bp, C. elegans
ttccaattttctc

SEQ ID NO: 734951 - DNA, 13 bp, C. elegans
ttccaattttgat

SEQ ID NO: 734952 - DNA, 13 bp, C. elegans
ttccaattttgga

SEQ ID NO: 734953 - DNA, 13 bp, C. elegans
ttccaatttttac

SEQ ID NO: 734954 - DNA, 13 bp, C. elegans
ttccaatttttcg

SEQ ID NO: 734955 - DNA, 13 bp, C. elegans
ttccaatttttgg

SEQ ID NO: 734956 - DNA, 13 bp, C. elegans
ttccaattttttg

SEQ ID NO: 734957 - DNA, 13 bp, C. elegans
ttccacaaaaaag

SEQ ID NO: 734958 - DNA, 13 bp, C. elegans
ttccacaaaacaa

SEQ ID NO: 734959 - DNA, 13 bp, C. elegans
ttccacaaaattt

SEQ ID NO: 734960 - DNA, 13 bp, C. elegans
ttccacaaagttt

SEQ ID NO: 734961 - DNA, 13 bp, C. elegans
ttccacaaatttt

SEQ ID NO: 734962 - DNA, 13 bp, C. elegans
ttccacaacttca

SEQ ID NO: 734963 - DNA, 13 bp, C. elegans
ttccacaattcaa

SEQ ID NO: 734964 - DNA, 13 bp, C. elegans
ttccacaatttca

SEQ ID NO: 734965 - DNA, 13 bp, C. elegans
ttccacaatttcc

SEQ ID NO: 734966 - DNA, 13 bp, C. elegans
ttccacacaaaaa

SEQ ID NO: 734967 - DNA, 13 bp, C. elegans
ttccacacgtttt

SEQ ID NO: 734968 - DNA, 13 bp, C. elegans
ttccacagtgtat

SEQ ID NO: 734969 - DNA, 13 bp, C. elegans
ttccacataaatt

SEQ ID NO: 734970 - DNA, 13 bp, C. elegans
ttccacatttcca

SEQ ID NO: 734971 - DNA, 13 bp, C. elegans
ttccacattttca

SEQ ID NO: 734972 - DNA, 13 bp, C. elegans
ttccacattttta

SEQ ID NO: 734973 - DNA, 13 bp, C. elegans
ttccaccaaaatt

SEQ ID NO: 734974 - DNA, 13 bp, C. elegans
ttccaccaacttt

SEQ ID NO: 734975 - DNA, 13 bp, C. elegans
ttccaccgaaaaa

SEQ ID NO: 734976 - DNA, 13 bp, C. elegans
ttccaccgaaaat

SEQ ID NO: 734977 - DNA, 13 bp, C. elegans
ttccacgaaaaat

SEQ ID NO: 734978 - DNA, 13 bp, C. elegans
ttccacgaaattg

SEQ ID NO: 734979 - DNA, 13 bp, C. elegans
ttccacgtgtttt

SEQ ID NO: 734980 - DNA, 14 bp, C. elegans
ttccacgtgttttc

SEQ ID NO: 734981 - DNA, 13 bp, C. elegans
ttccactaaaaac

SEQ ID NO: 734982 - DNA, 13 bp, C. elegans
ttccactaccgaa

SEQ ID NO: 734983 - DNA, 13 bp, C. elegans
ttccactatttca

SEQ ID NO: 734984 - DNA, 13 bp, C. elegans
ttccactatttct

SEQ ID NO: 734985 - DNA, 13 bp, C. elegans
ttccactgaaaac

SEQ ID NO: 734986 - DNA, 13 bp, C. elegans
ttccactgaaaat

SEQ ID NO: 734987 - DNA, 13 bp, C. elegans
ttccactgatttt

SEQ ID NO: 734988 - DNA, 13 bp, C. elegans
ttccactggaaaa

SEQ ID NO: 734989 - DNA, 13 bp, C. elegans
ttccacttatttc

SEQ ID NO: 734990 - DNA, 13 bp, C. elegans
ttccactttcatt

SEQ ID NO: 734991 - DNA, 13 bp, C. elegans
ttccacttttcat

SEQ ID NO: 734992 - DNA, 13 bp, C. elegans
ttccacttttcga

SEQ ID NO: 734993 - DNA, 13 bp, C. elegans
ttccacttttgaa

SEQ ID NO: 734994 - DNA, 13 bp, C. elegans
ttccagaaaaaaa

SEQ ID NO: 734995 - DNA, 13 bp, C. elegans
ttccagaaaaaag

SEQ ID NO: 734996 - DNA, 13 bp, C. elegans
ttccagaaaaaat

SEQ ID NO: 734997 - DNA, 13 bp, C. elegans
ttccagaaaaata

SEQ ID NO: 734998 - DNA, 13 bp, C. elegans
ttccagaaaaatg

SEQ ID NO: 734999 - DNA, 13 bp, C. elegans
ttccagaaaacat

SEQ ID NO: 735000 - DNA, 13 bp, C. elegans
ttccagaaaactt

SEQ ID NO: 735001 - DNA, 13 bp, C. elegans
ttccagaaaatct

SEQ ID NO: 735002 - DNA, 13 bp, C. elegans
ttccagaaacttt

SEQ ID NO: 735003 - DNA, 13 bp, C. elegans
ttccagaaataaa

SEQ ID NO: 735004 - DNA, 13 bp, C. elegans
ttccagaaatcaa

SEQ ID NO: 735005 - DNA, 13 bp, C. elegans
ttccagaaatgtt

SEQ ID NO: 735006 - DNA, 13 bp, C. elegans
ttccagaaattcc

SEQ ID NO: 735007 - DNA, 13 bp, C. elegans
ttccagaaattta

SEQ ID NO: 735008 - DNA, 13 bp, C. elegans
ttccagaaatttc

SEQ ID NO: 735009 - DNA, 13 bp, C. elegans
ttccagaaccaaa

SEQ ID NO: 735010 - DNA, 13 bp, C. elegans
ttccagaactttc

SEQ ID NO: 735011 - DNA, 13 bp, C. elegans
ttccagaactttg

SEQ ID NO: 735012 - DNA, 13 bp, C. elegans
ttccagaagaaaa

SEQ ID NO: 735013 - DNA, 13 bp, C. elegans
ttccagaagaatt

SEQ ID NO: 735014 - DNA, 13 bp, C. elegans
ttccagaagattc

SEQ ID NO: 735015 - DNA, 13 bp, C. elegans
ttccagaagcttc

SEQ ID NO: 735016 - DNA, 13 bp, C. elegans
ttccagaaggttc

SEQ ID NO: 735017 - DNA, 13 bp, C. elegans
ttccagaatatat

SEQ ID NO: 735018 - DNA, 13 bp, C. elegans
ttccagaatattt

SEQ ID NO: 735019 - DNA, 13 bp, C. elegans
ttccagaatgttc

SEQ ID NO: 735020 - DNA, 13 bp, C. elegans
ttccagaattgaa

SEQ ID NO: 735021 - DNA, 13 bp, C. elegans
ttccagaatttta

SEQ ID NO: 735022 - DNA, 13 bp, C. elegans
ttccagaattttc

SEQ ID NO: 735023 - DNA, 13 bp, C. elegans
ttccagacatttt

SEQ ID NO: 735024 - DNA, 13 bp, C. elegans
ttccagacttttc

SEQ ID NO: 735025 - DNA, 13 bp, C. elegans
ttccagagaaaat

SEQ ID NO: 735026 - DNA, 13 bp, C. elegans
ttccagagatttt

SEQ ID NO: 735027 - DNA, 13 bp, C. elegans
ttccagagttttc

SEQ ID NO: 735028 - DNA, 13 bp, C. elegans
ttccagataattt

SEQ ID NO: 735029 - DNA, 13 bp, C. elegans
ttccagatatttt

SEQ ID NO: 735030 - DNA, 13 bp, C. elegans
ttccagatttcca

SEQ ID NO: 735031 - DNA, 13 bp, C. elegans
ttccagatttctt

SEQ ID NO: 735032 - DNA, 13 bp, C. elegans
ttccagattttct

SEQ ID NO: 735033 - DNA, 13 bp, C. elegans
ttccagatttttc

SEQ ID NO: 735034 - DNA, 13 bp, C. elegans
ttccagcaaaaaa

SEQ ID NO: 735035 - DNA, 13 bp, C. elegans
ttccagcaaaaat

SEQ ID NO: 735036 - DNA, 13 bp, C. elegans
ttccagcaaaatt

SEQ ID NO: 735037 - DNA, 13 bp, C. elegans
ttccagcaaattt

SEQ ID NO: 735038 - DNA, 13 bp, C. elegans
ttccagcaattta

SEQ ID NO: 735039 - DNA, 13 bp, C. elegans
ttccagcaatttt

SEQ ID NO: 735040 - DNA, 13 bp, C. elegans
ttccagcattttc

SEQ ID NO: 735041 - DNA, 13 bp, C. elegans
ttccagcattttt

SEQ ID NO: 735042 - DNA, 13 bp, C. elegans
ttccagccaattt

SEQ ID NO: 735043 - DNA, 13 bp, C. elegans
ttccagccatttt

SEQ ID NO: 735044 - DNA, 13 bp, C. elegans
ttccagctaaaat

SEQ ID NO: 735045 - DNA, 13 bp, C. elegans
ttccagctatttt

SEQ ID NO: 735046 - DNA, 13 bp, C. elegans
ttccagctgaaaa

SEQ ID NO: 735047 - DNA, 13 bp, C. elegans
ttccagctgctgc

SEQ ID NO: 735048 - DNA, 13 bp, C. elegans
ttccagcttttcc

SEQ ID NO: 735049 - DNA, 13 bp, C. elegans
ttccagctttttc

SEQ ID NO: 735050 - DNA, 13 bp, C. elegans
ttccagtaatttc

SEQ ID NO: 735051 - DNA, 13 bp, C. elegans
ttccagtactttt

SEQ ID NO: 735052 - DNA, 13 bp, C. elegans
ttccagtagtttt

SEQ ID NO: 735053 - DNA, 13 bp, C. elegans
ttccagtattttc

SEQ ID NO: 735054 - DNA, 13 bp, C. elegans
ttccagtggtttt

SEQ ID NO: 735055 - DNA, 13 bp, C. elegans
ttccagttcaatc

SEQ ID NO: 735056 - DNA, 13 bp, C. elegans
ttccagttgaaaa

SEQ ID NO: 735057 - DNA, 13 bp, C. elegans
ttccagtttcaaa

SEQ ID NO: 735058 - DNA, 13 bp, C. elegans
ttccagttttcaa

SEQ ID NO: 735059 - DNA, 13 bp, C. elegans
ttccagttttctt

SEQ ID NO: 735060 - DNA, 13 bp, C. elegans
ttccagtttttat

SEQ ID NO: 735061 - DNA, 13 bp, C. elegans
ttccataaaaatt

SEQ ID NO: 735062 - DNA, 13 bp, C. elegans
ttccataataatt

SEQ ID NO: 735063 - DNA, 13 bp, C. elegans
ttccataatgttt

SEQ ID NO: 735064 - DNA, 13 bp, C. elegans
ttccataatttca

SEQ ID NO: 735065 - DNA, 13 bp, C. elegans
ttccataatttgt

SEQ ID NO: 735066 - DNA, 13 bp, C. elegans
ttccatagaattt

SEQ ID NO: 735067 - DNA, 13 bp, C. elegans
ttccatataaaaa

SEQ ID NO: 735068 - DNA, 13 bp, C. elegans
ttccatataaaat

SEQ ID NO: 735069 - DNA, 13 bp, C. elegans
ttccatatataaa

SEQ ID NO: 735070 - DNA, 13 bp, C. elegans
ttccatatttcca

SEQ ID NO: 735071 - DNA, 13 bp, C. elegans
ttccatatttcta

SEQ ID NO: 735072 - DNA, 13 bp, C. elegans
ttccatattttca

SEQ ID NO: 735073 - DNA, 13 bp, C. elegans
ttccatcaaaaaa

SEQ ID NO: 735074 - DNA, 13 bp, C. elegans
ttccatcaaaaac

SEQ ID NO: 735075 - DNA, 13 bp, C. elegans
ttccatcaaaaat

SEQ ID NO: 735076 - DNA, 13 bp, C. elegans
ttccatcaaaatt

SEQ ID NO: 735077 - DNA, 13 bp, C. elegans
ttccatcaaataa

SEQ ID NO: 735078 - DNA, 13 bp, C. elegans
ttccatcaaattt

SEQ ID NO: 735079 - DNA, 13 bp, C. elegans
ttccatcaacttt

SEQ ID NO: 735080 - DNA, 13 bp, C. elegans
ttccatcatcatc

SEQ ID NO: 735081 - DNA, 13 bp, C. elegans
ttccatccaaaaa

SEQ ID NO: 735082 - DNA, 13 bp, C. elegans
ttccatcgaaaaa

SEQ ID NO: 735083 - DNA, 13 bp, C. elegans
ttccatcgatttt

SEQ ID NO: 735084 - DNA, 13 bp, C. elegans
ttccatcgtcatc

SEQ ID NO: 735085 - DNA, 13 bp, C. elegans
ttccatctcaatt

SEQ ID NO: 735086 - DNA, 13 bp, C. elegans
ttccatctgaaaa

SEQ ID NO: 735087 - DNA, 13 bp, C. elegans
ttccatgcaattt

SEQ ID NO: 735088 - DNA, 13 bp, C. elegans
ttccatggttttt

SEQ ID NO: 735089 - DNA, 13 bp, C. elegans
ttccatgttttca

SEQ ID NO: 735090 - DNA, 13 bp, C. elegans
ttccatgttttga

SEQ ID NO: 735091 - DNA, 13 bp, C. elegans
ttccattaattta

SEQ ID NO: 735092 - DNA, 13 bp, C. elegans
ttccattattgtt

SEQ ID NO: 735093 - DNA, 13 bp, C. elegans
ttccattcaaaat

SEQ ID NO: 735094 - DNA, 13 bp, C. elegans
ttccattcaattt

SEQ ID NO: 735095 - DNA, 13 bp, C. elegans
ttccattcacttt

SEQ ID NO: 735096 - DNA, 13 bp, C. elegans
ttccattccaaaa

SEQ ID NO: 735097 - DNA, 13 bp, C. elegans
ttccattccattt

SEQ ID NO: 735098 - DNA, 13 bp, C. elegans
ttccattgaaaaa

SEQ ID NO: 735099 - DNA, 13 bp, C. elegans
ttccattgaaaat

SEQ ID NO: 735100 - DNA, 13 bp, C. elegans
ttccattgttttc

SEQ ID NO: 735101 - DNA, 13 bp, C. elegans
ttccatttaaaaa

SEQ ID NO: 735102 - DNA, 13 bp, C. elegans
ttccatttaaata

SEQ ID NO: 735103 - DNA, 13 bp, C. elegans
ttccatttaaatt

SEQ ID NO: 735104 - DNA, 13 bp, C. elegans
ttccatttcaaaa

SEQ ID NO: 735105 - DNA, 14 bp, C. elegans
ttccatttcaaaat

SEQ ID NO: 735106 - DNA, 13 bp, C. elegans
ttccatttcaatt

SEQ ID NO: 735107 - DNA, 13 bp, C. elegans
ttccatttccaaa

SEQ ID NO: 735108 - DNA, 13 bp, C. elegans
ttccatttgaatt

SEQ ID NO: 735109 - DNA, 14 bp, C. elegans
ttccatttgcactt

SEQ ID NO: 735110 - DNA, 13 bp, C. elegans
ttccattttaaaa

SEQ ID NO: 735111 - DNA, 13 bp, C. elegans
ttccattttaaat

SEQ ID NO: 735112 - DNA, 13 bp, C. elegans
ttccattttaata

SEQ ID NO: 735113 - DNA, 13 bp, C. elegans
ttccattttcaaa

SEQ ID NO: 735114 - DNA, 13 bp, C. elegans
ttccattttccag

SEQ ID NO: 735115 - DNA, 13 bp, C. elegans
ttccattttccat

SEQ ID NO: 735116 - DNA, 13 bp, C. elegans
ttccattttccga

SEQ ID NO: 735117 - DNA, 13 bp, C. elegans
ttccattttctca

SEQ ID NO: 735118 - DNA, 13 bp, C. elegans
ttccattttctga

SEQ ID NO: 735119 - DNA, 13 bp, C. elegans
ttccattttgaac

SEQ ID NO: 735120 - DNA, 13 bp, C. elegans
ttccatttttcaa

SEQ ID NO: 735121 - DNA, 13 bp, C. elegans
ttccatttttcac

SEQ ID NO: 735122 - DNA, 13 bp, C. elegans
ttccatttttcga

SEQ ID NO: 735123 - DNA, 13 bp, C. elegans
ttccatttttgcc

SEQ ID NO: 735124 - DNA, 13 bp, C. elegans
ttccatttttggt

SEQ ID NO: 735125 - DNA, 14 bp, C. elegans
ttccattttttgct

SEQ ID NO: 735126 - DNA, 13 bp, C. elegans
ttccattttttgg

SEQ ID NO: 735127 - DNA, 13 bp, C. elegans
ttcccaaaaaaag

SEQ ID NO: 735128 - DNA, 13 bp, C. elegans
ttcccaaaaaaat

SEQ ID NO: 735129 - DNA, 13 bp, C. elegans
ttcccaaaaacaa

SEQ ID NO: 735130 - DNA, 13 bp, C. elegans
ttcccaaaaactt

SEQ ID NO: 735131 - DNA, 13 bp, C. elegans
ttcccaaaaagga

SEQ ID NO: 735132 - DNA, 13 bp, C. elegans
ttcccaaaaatat

SEQ ID NO: 735133 - DNA, 13 bp, C. elegans
ttcccaaaaatct

SEQ ID NO: 735134 - DNA, 13 bp, C. elegans
ttcccaaaattcc

SEQ ID NO: 735135 - DNA, 13 bp, C. elegans
ttcccaaaatttc

SEQ ID NO: 735136 - DNA, 13 bp, C. elegans
ttcccaaaatttg

SEQ ID NO: 735137 - DNA, 13 bp, C. elegans
ttcccaaatattt

SEQ ID NO: 735138 - DNA, 13 bp, C. elegans
ttcccaaatgttc

SEQ ID NO: 735139 - DNA, 13 bp, C. elegans
ttcccaacttttc

SEQ ID NO: 735140 - DNA, 13 bp, C. elegans
ttcccaagaaaaa

SEQ ID NO: 735141 - DNA, 13 bp, C. elegans
ttcccaatttcaa

SEQ ID NO: 735142 - DNA, 13 bp, C. elegans
ttcccaatttcca

SEQ ID NO: 735143 - DNA, 13 bp, C. elegans
ttcccaatttctc

SEQ ID NO: 735144 - DNA, 14 bp, C. elegans
ttcccaattttccc

SEQ ID NO: 735145 - DNA, 13 bp, C. elegans
ttcccaatttttc

SEQ ID NO: 735146 - DNA, 13 bp, C. elegans
ttcccacaaaatt

SEQ ID NO: 735147 - DNA, 13 bp, C. elegans
ttcccacaatttc

SEQ ID NO: 735148 - DNA, 13 bp, C. elegans
ttcccactggcgc

SEQ ID NO: 735149 - DNA, 13 bp, C. elegans
ttcccagaaattt

SEQ ID NO: 735150 - DNA, 13 bp, C. elegans
ttcccagaatttt

SEQ ID NO: 735151 - DNA, 13 bp, C. elegans
ttcccagattttt

SEQ ID NO: 735152 - DNA, 13 bp, C. elegans
ttcccagttttct

SEQ ID NO: 735153 - DNA, 13 bp, C. elegans
ttcccatattttc

SEQ ID NO: 735154 - DNA, 13 bp, C. elegans
ttcccattaagtt

SEQ ID NO: 735155 - DNA, 13 bp, C. elegans
ttcccattcaatt

SEQ ID NO: 735156 - DNA, 13 bp, C. elegans
ttcccattgattt

SEQ ID NO: 735157 - DNA, 13 bp, C. elegans
ttcccattgctca

SEQ ID NO: 735158 - DNA, 14 bp, C. elegans
ttcccattgctcag

SEQ ID NO: 735159 - DNA, 13 bp, C. elegans
ttcccatttaaaa

SEQ ID NO: 735160 - DNA, 13 bp, C. elegans
ttcccattttcca

SEQ ID NO: 735161 - DNA, 13 bp, C. elegans
ttccccaaaaaaa

SEQ ID NO: 735162 - DNA, 13 bp, C. elegans
ttccccaaaaact

SEQ ID NO: 735163 - DNA, 13 bp, C. elegans
ttccccaaaaatg

SEQ ID NO: 735164 - DNA, 13 bp, C. elegans
ttccccaaaaatt

SEQ ID NO: 735165 - DNA, 13 bp, C. elegans
ttccccaatttca

SEQ ID NO: 735166 - DNA, 13 bp, C. elegans
ttccccccaaaat

SEQ ID NO: 735167 - DNA, 13 bp, C. elegans
ttccccgaaaaaa

SEQ ID NO: 735168 - DNA, 13 bp, C. elegans
ttccccgattttc

SEQ ID NO: 735169 - DNA, 13 bp, C. elegans
ttccccgcaaaaa

SEQ ID NO: 735170 - DNA, 13 bp, C. elegans
ttcccgaaaaata

SEQ ID NO: 735171 - DNA, 13 bp, C. elegans
ttcccgaaaatga

SEQ ID NO: 735172 - DNA, 13 bp, C. elegans
ttcccgaagtttc

SEQ ID NO: 735173 - DNA, 13 bp, C. elegans
ttcccgagaaaat

SEQ ID NO: 735174 - DNA, 13 bp, C. elegans
ttcccgattttcc

SEQ ID NO: 735175 - DNA, 13 bp, C. elegans
ttcccgatttttc

SEQ ID NO: 735176 - DNA, 13 bp, C. elegans
ttcccgcaaattt

SEQ ID NO: 735177 - DNA, 13 bp, C. elegans
ttcccgcatttct

SEQ ID NO: 735178 - DNA, 14 bp, C. elegans
ttcccgcattttta

SEQ ID NO: 735179 - DNA, 13 bp, C. elegans
ttcccgccaaaac

SEQ ID NO: 735180 - DNA, 13 bp, C. elegans
ttcccgccaaaat

SEQ ID NO: 735181 - DNA, 14 bp, C. elegans
ttcccgccaaaatg

SEQ ID NO: 735182 - DNA, 13 bp, C. elegans
ttcccgctaaaaa

SEQ ID NO: 735183 - DNA, 13 bp, C. elegans
ttcccgctgaaaa

SEQ ID NO: 735184 - DNA, 13 bp, C. elegans
ttcccggtcgatg

SEQ ID NO: 735185 - DNA, 13 bp, C. elegans
ttcccgtaaaaat

SEQ ID NO: 735186 - DNA, 13 bp, C. elegans
ttcccgtgaaaat

SEQ ID NO: 735187 - DNA, 13 bp, C. elegans
ttcccgtttttca

SEQ ID NO: 735188 - DNA, 13 bp, C. elegans
ttccctcaaaaaa

SEQ ID NO: 735189 - DNA, 13 bp, C. elegans
ttccctcaaaatt

SEQ ID NO: 735190 - DNA, 13 bp, C. elegans
ttccctccaaaaa

SEQ ID NO: 735191 - DNA, 13 bp, C. elegans
ttccctccaaaac

SEQ ID NO: 735192 - DNA, 13 bp, C. elegans
ttccctccaattt

SEQ ID NO: 735193 - DNA, 13 bp, C. elegans
ttccctgaaaaaa

SEQ ID NO: 735194 - DNA, 13 bp, C. elegans
ttccctgaaattt

SEQ ID NO: 735195 - DNA, 13 bp, C. elegans
ttcccttttttga

SEQ ID NO: 735196 - DNA, 13 bp, C. elegans
ttccgaaaaaaca

SEQ ID NO: 735197 - DNA, 13 bp, C. elegans
ttccgaaaaaaga

SEQ ID NO: 735198 - DNA, 13 bp, C. elegans
ttccgaaaaaatg

SEQ ID NO: 735199 - DNA, 13 bp, C. elegans
ttccgaaaaaatt

SEQ ID NO: 735200 - DNA, 13 bp, C. elegans
ttccgaaaaagta

SEQ ID NO: 735201 - DNA, 13 bp, C. elegans
ttccgaaaaatat

SEQ ID NO: 735202 - DNA, 13 bp, C. elegans
ttccgaaaaatcc

SEQ ID NO: 735203 - DNA, 13 bp, C. elegans
ttccgaaaaattt

SEQ ID NO: 735204 - DNA, 13 bp, C. elegans
ttccgaaaatcaa

SEQ ID NO: 735205 - DNA, 13 bp, C. elegans
ttccgaaaatcgg

SEQ ID NO: 735206 - DNA, 13 bp, C. elegans
ttccgaaaatgaa

SEQ ID NO: 735207 - DNA, 13 bp, C. elegans
ttccgaaaattaa

SEQ ID NO: 735208 - DNA, 13 bp, C. elegans
ttccgaaaattat

SEQ ID NO: 735209 - DNA, 13 bp, C. elegans
ttccgaaataaaa

SEQ ID NO: 735210 - DNA, 13 bp, C. elegans
ttccgaaatattt

SEQ ID NO: 735211 - DNA, 13 bp, C. elegans
ttccgaaatgtgt

SEQ ID NO: 735212 - DNA, 13 bp, C. elegans
ttccgaaattcca

SEQ ID NO: 735213 - DNA, 13 bp, C. elegans
ttccgaaatttaa

SEQ ID NO: 735214 - DNA, 13 bp, C. elegans
ttccgaacttttt

SEQ ID NO: 735215 - DNA, 13 bp, C. elegans
ttccgaataaaaa

SEQ ID NO: 735216 - DNA, 13 bp, C. elegans
ttccgaataattt

SEQ ID NO: 735217 - DNA, 13 bp, C. elegans
ttccgaatatcaa

SEQ ID NO: 735218 - DNA, 13 bp, C. elegans
ttccgaatatttt

SEQ ID NO: 735219 - DNA, 13 bp, C. elegans
ttccgaatttcaa

SEQ ID NO: 735220 - DNA, 13 bp, C. elegans
ttccgaatttcta

SEQ ID NO: 735221 - DNA, 13 bp, C. elegans
ttccgacaaatcg

SEQ ID NO: 735222 - DNA, 13 bp, C. elegans
ttccgacaattta

SEQ ID NO: 735223 - DNA, 13 bp, C. elegans
ttccgacaatttc

SEQ ID NO: 735224 - DNA, 13 bp, C. elegans
ttccgacaatttg

SEQ ID NO: 735225 - DNA, 13 bp, C. elegans
ttccgacaatttt

SEQ ID NO: 735226 - DNA, 13 bp, C. elegans
ttccgagaaaaat

SEQ ID NO: 735227 - DNA, 13 bp, C. elegans
ttccgagaaaatt

SEQ ID NO: 735228 - DNA, 13 bp, C. elegans
ttccgagcaaaaa

SEQ ID NO: 735229 - DNA, 13 bp, C. elegans
ttccgagtaaaaa

SEQ ID NO: 735230 - DNA, 13 bp, C. elegans
ttccgagttttca

SEQ ID NO: 735231 - DNA, 13 bp, C. elegans
ttccgagtttttc

SEQ ID NO: 735232 - DNA, 13 bp, C. elegans
ttccgatgaattt

SEQ ID NO: 735233 - DNA, 13 bp, C. elegans
ttccgattcaaaa

SEQ ID NO: 735234 - DNA, 13 bp, C. elegans
ttccgattttccc

SEQ ID NO: 735235 - DNA, 13 bp, C. elegans
ttccgattttcga

SEQ ID NO: 735236 - DNA, 13 bp, C. elegans
ttccgattttctc

SEQ ID NO: 735237 - DNA, 13 bp, C. elegans
ttccgatttttac

SEQ ID NO: 735238 - DNA, 13 bp, C. elegans
ttccgatttttat

SEQ ID NO: 735239 - DNA, 13 bp, C. elegans
ttccgatttttca

SEQ ID NO: 735240 - DNA, 13 bp, C. elegans
ttccgatttttcg

SEQ ID NO: 735241 - DNA, 13 bp, C. elegans
ttccgatttttct

SEQ ID NO: 735242 - DNA, 13 bp, C. elegans
ttccgattttttc

SEQ ID NO: 735243 - DNA, 13 bp, C. elegans
ttccgcagcaaca

SEQ ID NO: 735244 - DNA, 13 bp, C. elegans
ttccgcataaatg

SEQ ID NO: 735245 - DNA, 13 bp, C. elegans
ttccgcatttttc

SEQ ID NO: 735246 - DNA, 13 bp, C. elegans
ttccgccaaaaac

SEQ ID NO: 735247 - DNA, 13 bp, C. elegans
ttccgccaaattt

SEQ ID NO: 735248 - DNA, 13 bp, C. elegans
ttccgccaatatt

SEQ ID NO: 735249 - DNA, 13 bp, C. elegans
ttccgccaatttg

SEQ ID NO: 735250 - DNA, 13 bp, C. elegans
ttccgccgctgaa

SEQ ID NO: 735251 - DNA, 13 bp, C. elegans
ttccgcgacgaaa

SEQ ID NO: 735252 - DNA, 13 bp, C. elegans
ttccgctaatttt

SEQ ID NO: 735253 - DNA, 13 bp, C. elegans
ttccgctattttt

SEQ ID NO: 735254 - DNA, 13 bp, C. elegans
ttccgctgatttt

SEQ ID NO: 735255 - DNA, 13 bp, C. elegans
ttccgcttccatt

SEQ ID NO: 735256 - DNA, 13 bp, C. elegans
ttccgctttgcct

SEQ ID NO: 735257 - DNA, 13 bp, C. elegans
ttccggaaaaacg

SEQ ID NO: 735258 - DNA, 13 bp, C. elegans
ttccggaaaattt

SEQ ID NO: 735259 - DNA, 13 bp, C. elegans
ttccggaaattat

SEQ ID NO: 735260 - DNA, 13 bp, C. elegans
ttccggaaatttg

SEQ ID NO: 735261 - DNA, 13 bp, C. elegans
ttccggaagaaaa

SEQ ID NO: 735262 - DNA, 13 bp, C. elegans
ttccggaatttat

SEQ ID NO: 735263 - DNA, 13 bp, C. elegans
ttccggaattttg

SEQ ID NO: 735264 - DNA, 13 bp, C. elegans
ttccggagaaaaa

SEQ ID NO: 735265 - DNA, 13 bp, C. elegans
ttccggatttttt

SEQ ID NO: 735266 - DNA, 13 bp, C. elegans
ttccggcaaacca

SEQ ID NO: 735267 - DNA, 13 bp, C. elegans
ttccggcaaatcg

SEQ ID NO: 735268 - DNA, 13 bp, C. elegans
ttccggcaaatct

SEQ ID NO: 735269 - DNA, 13 bp, C. elegans
ttccggcaatttt

SEQ ID NO: 735270 - DNA, 13 bp, C. elegans
ttccggcagattg

SEQ ID NO: 735271 - DNA, 13 bp, C. elegans
ttccggcagtttt

SEQ ID NO: 735272 - DNA, 13 bp, C. elegans
ttccggcgatttt

SEQ ID NO: 735273 - DNA, 13 bp, C. elegans
ttccggcggaaaa

SEQ ID NO: 735274 - DNA, 13 bp, C. elegans
ttccggctaattg

SEQ ID NO: 735275 - DNA, 13 bp, C. elegans
ttccgggaatttt

SEQ ID NO: 735276 - DNA, 13 bp, C. elegans
ttccgggtcaaaa

SEQ ID NO: 735277 - DNA, 13 bp, C. elegans
ttccggtattttt

SEQ ID NO: 735278 - DNA, 13 bp, C. elegans
ttccggttttcaa

SEQ ID NO: 735279 - DNA, 13 bp, C. elegans
ttccgtaaaaaat

SEQ ID NO: 735280 - DNA, 13 bp, C. elegans
ttccgtaattttc

SEQ ID NO: 735281 - DNA, 13 bp, C. elegans
ttccgtattttca

SEQ ID NO: 735282 - DNA, 13 bp, C. elegans
ttccgtatttttg

SEQ ID NO: 735283 - DNA, 13 bp, C. elegans
ttccgtcaaaaat

SEQ ID NO: 735284 - DNA, 13 bp, C. elegans
ttccgtcaaattc

SEQ ID NO: 735285 - DNA, 13 bp, C. elegans
ttccgtcattttc

SEQ ID NO: 735286 - DNA, 13 bp, C. elegans
ttccgtctcataa

SEQ ID NO: 735287 - DNA, 13 bp, C. elegans
ttccgtctgaaaa

SEQ ID NO: 735288 - DNA, 13 bp, C. elegans
ttccgtgaaaaaa

SEQ ID NO: 735289 - DNA, 13 bp, C. elegans
ttccgttcaaatt

SEQ ID NO: 735290 - DNA, 13 bp, C. elegans
ttccgtttcaaat

SEQ ID NO: 735291 - DNA, 13 bp, C. elegans
ttccgttttctga

SEQ ID NO: 735292 - DNA, 13 bp, C. elegans
ttccgtttttgaa

SEQ ID NO: 735293 - DNA, 13 bp, C. elegans
ttcctaaaaatcc

SEQ ID NO: 735294 - DNA, 13 bp, C. elegans
ttcctaaaatttt

SEQ ID NO: 735295 - DNA, 13 bp, C. elegans
ttcctaaattttc

SEQ ID NO: 735296 - DNA, 13 bp, C. elegans
ttcctacaatttg

SEQ ID NO: 735297 - DNA, 13 bp, C. elegans
ttcctaccgtacc

SEQ ID NO: 735298 - DNA, 13 bp, C. elegans
ttcctactcattt

SEQ ID NO: 735299 - DNA, 13 bp, C. elegans
ttcctactgaaaa

SEQ ID NO: 735300 - DNA, 13 bp, C. elegans
ttcctagaaaaat

SEQ ID NO: 735301 - DNA, 13 bp, C. elegans
ttcctagaaaatc

SEQ ID NO: 735302 - DNA, 13 bp, C. elegans
ttcctagaaaatt

SEQ ID NO: 735303 - DNA, 13 bp, C. elegans
ttcctagatttta

SEQ ID NO: 735304 - DNA, 13 bp, C. elegans
ttcctaggccacg

SEQ ID NO: 735305 - DNA, 13 bp, C. elegans
ttcctagtttttc

SEQ ID NO: 735306 - DNA, 13 bp, C. elegans
ttcctataaaaat

SEQ ID NO: 735307 - DNA, 13 bp, C. elegans
ttcctataacttt

SEQ ID NO: 735308 - DNA, 13 bp, C. elegans
ttcctatcaaaaa

SEQ ID NO: 735309 - DNA, 13 bp, C. elegans
ttcctatcaattt

SEQ ID NO: 735310 - DNA, 13 bp, C. elegans
ttcctatctcatg

SEQ ID NO: 735311 - DNA, 14 bp, C. elegans
ttcctatttgaatt

SEQ ID NO: 735312 - DNA, 13 bp, C. elegans
ttcctattttctg

SEQ ID NO: 735313 - DNA, 13 bp, C. elegans
ttcctatttttag

SEQ ID NO: 735314 - DNA, 13 bp, C. elegans
ttcctcaaaaaag

SEQ ID NO: 735315 - DNA, 13 bp, C. elegans
ttcctcaaaattc

SEQ ID NO: 735316 - DNA, 13 bp, C. elegans
ttcctcaaatatt

SEQ ID NO: 735317 - DNA, 13 bp, C. elegans
ttcctcaatttct

SEQ ID NO: 735318 - DNA, 13 bp, C. elegans
ttcctcaattttc

SEQ ID NO: 735319 - DNA, 13 bp, C. elegans
ttcctcacaaaaa

SEQ ID NO: 735320 - DNA, 13 bp, C. elegans
ttcctcattgaat

SEQ ID NO: 735321 - DNA, 14 bp, C. elegans
ttcctcattgcatt

SEQ ID NO: 735322 - DNA, 13 bp, C. elegans
ttcctccaaaatg

SEQ ID NO: 735323 - DNA, 13 bp, C. elegans
ttcctcgaaaaat

SEQ ID NO: 735324 - DNA, 13 bp, C. elegans
ttcctcgacagaa

SEQ ID NO: 735325 - DNA, 13 bp, C. elegans
ttcctcgagaaaa

SEQ ID NO: 735326 - DNA, 13 bp, C. elegans
ttcctcgaggagt

SEQ ID NO: 735327 - DNA, 13 bp, C. elegans
ttcctcggaaaat

SEQ ID NO: 735328 - DNA, 13 bp, C. elegans
ttcctctcaattt

SEQ ID NO: 735329 - DNA, 13 bp, C. elegans
ttcctgaaaaaaa

SEQ ID NO: 735330 - DNA, 13 bp, C. elegans
ttcctgaaaaatg

SEQ ID NO: 735331 - DNA, 13 bp, C. elegans
ttcctgaaaattg

SEQ ID NO: 735332 - DNA, 13 bp, C. elegans
ttcctgaatttct

SEQ ID NO: 735333 - DNA, 13 bp, C. elegans
ttcctgaattttg

SEQ ID NO: 735334 - DNA, 13 bp, C. elegans
ttcctgattttca

SEQ ID NO: 735335 - DNA, 13 bp, C. elegans
ttcctgatttttc

SEQ ID NO: 735336 - DNA, 13 bp, C. elegans
ttcctgatttttg

SEQ ID NO: 735337 - DNA, 13 bp, C. elegans
ttcctgccaaatt

SEQ ID NO: 735338 - DNA, 13 bp, C. elegans
ttcctggaaaatc

SEQ ID NO: 735339 - DNA, 13 bp, C. elegans
ttcctggagtttt

SEQ ID NO: 735340 - DNA, 13 bp, C. elegans
ttcctgtaatata

SEQ ID NO: 735341 - DNA, 13 bp, C. elegans
ttcctgtattttc

SEQ ID NO: 735342 - DNA, 13 bp, C. elegans
ttcctgtcaattt

SEQ ID NO: 735343 - DNA, 13 bp, C. elegans
ttcctgtcatttt

SEQ ID NO: 735344 - DNA, 13 bp, C. elegans
ttcctgtgaaatt

SEQ ID NO: 735345 - DNA, 13 bp, C. elegans
ttcctgttgattt

SEQ ID NO: 735346 - DNA, 13 bp, C. elegans
ttcctgtttcaaa

SEQ ID NO: 735347 - DNA, 13 bp, C. elegans
ttcctgtttcact

SEQ ID NO: 735348 - DNA, 13 bp, C. elegans
ttcctgttttcat

SEQ ID NO: 735349 - DNA, 13 bp, C. elegans
ttcctgttttgaa

SEQ ID NO: 735350 - DNA, 13 bp, C. elegans
ttccttaaaattt

SEQ ID NO: 735351 - DNA, 13 bp, C. elegans
ttccttcaaaaat

SEQ ID NO: 735352 - DNA, 13 bp, C. elegans
ttccttcaaaaga

SEQ ID NO: 735353 - DNA, 13 bp, C. elegans
ttccttcaaaatt

SEQ ID NO: 735354 - DNA, 13 bp, C. elegans
ttccttcaattaa

SEQ ID NO: 735355 - DNA, 13 bp, C. elegans
ttccttcataaat

SEQ ID NO: 735356 - DNA, 13 bp, C. elegans
ttccttccaaaat

SEQ ID NO: 735357 - DNA, 13 bp, C. elegans
ttccttctgaaaa

SEQ ID NO: 735358 - DNA, 13 bp, C. elegans
ttccttgcaaaat

SEQ ID NO: 735359 - DNA, 13 bp, C. elegans
ttccttggagctc

SEQ ID NO: 735360 - DNA, 13 bp, C. elegans
ttccttgttcata

SEQ ID NO: 735361 - DNA, 13 bp, C. elegans
ttcctttaaaaaa

SEQ ID NO: 735362 - DNA, 13 bp, C. elegans
ttcctttcaaaaa

SEQ ID NO: 735363 - DNA, 13 bp, C. elegans
ttcctttcattca

SEQ ID NO: 735364 - DNA, 13 bp, C. elegans
ttccttttcaaaa

SEQ ID NO: 735365 - DNA, 13 bp, C. elegans
ttccttttccaat

SEQ ID NO: 735366 - DNA, 13 bp, C. elegans
ttccttttctgaa

SEQ ID NO: 735367 - DNA, 13 bp, C. elegans
ttccttttttaga

SEQ ID NO: 735368 - DNA, 13 bp, C. elegans
ttcgaaaaaaatt

SEQ ID NO: 735369 - DNA, 13 bp, C. elegans
ttcgaaaaaactc

SEQ ID NO: 735370 - DNA, 13 bp, C. elegans
ttcgaaaaaagtt

SEQ ID NO: 735371 - DNA, 13 bp, C. elegans
ttcgaaaaaatag

SEQ ID NO: 735372 - DNA, 13 bp, C. elegans
ttcgaaaaaattc

SEQ ID NO: 735373 - DNA, 13 bp, C. elegans
ttcgaaaaacaac

SEQ ID NO: 735374 - DNA, 13 bp, C. elegans
ttcgaaaaactgc

SEQ ID NO: 735375 - DNA, 13 bp, C. elegans
ttcgaaaaacttg

SEQ ID NO: 735376 - DNA, 13 bp, C. elegans
ttcgaaaaacttt

SEQ ID NO: 735377 - DNA, 13 bp, C. elegans
ttcgaaaaagtcc

SEQ ID NO: 735378 - DNA, 13 bp, C. elegans
ttcgaaaaataaa

SEQ ID NO: 735379 - DNA, 13 bp, C. elegans
ttcgaaaaatatg

SEQ ID NO: 735380 - DNA, 13 bp, C. elegans
ttcgaaaaatcat

SEQ ID NO: 735381 - DNA, 13 bp, C. elegans
ttcgaaaaatgaa

SEQ ID NO: 735382 - DNA, 13 bp, C. elegans
ttcgaaaaatgcg

SEQ ID NO: 735383 - DNA, 13 bp, C. elegans
ttcgaaaaatgtg

SEQ ID NO: 735384 - DNA, 13 bp, C. elegans
ttcgaaaaattaa

SEQ ID NO: 735385 - DNA, 13 bp, C. elegans
ttcgaaaaattgt

SEQ ID NO: 735386 - DNA, 13 bp, C. elegans
ttcgaaaaattta

SEQ ID NO: 735387 - DNA, 13 bp, C. elegans
ttcgaaaacaaaa

SEQ ID NO: 735388 - DNA, 13 bp, C. elegans
ttcgaaaacaaat

SEQ ID NO: 735389 - DNA, 13 bp, C. elegans
ttcgaaaaccaaa

SEQ ID NO: 735390 - DNA, 13 bp, C. elegans
ttcgaaaacttca

SEQ ID NO: 735391 - DNA, 13 bp, C. elegans
ttcgaaaacttga

SEQ ID NO: 735392 - DNA, 13 bp, C. elegans
ttcgaaaactttc

SEQ ID NO: 735393 - DNA, 13 bp, C. elegans
ttcgaaaactttt

SEQ ID NO: 735394 - DNA, 13 bp, C. elegans
ttcgaaaagaatt

SEQ ID NO: 735395 - DNA, 13 bp, C. elegans
ttcgaaaagttca

SEQ ID NO: 735396 - DNA, 13 bp, C. elegans
ttcgaaaataata

SEQ ID NO: 735397 - DNA, 13 bp, C. elegans
ttcgaaaatactt

SEQ ID NO: 735398 - DNA, 13 bp, C. elegans
ttcgaaaatagta

SEQ ID NO: 735399 - DNA, 13 bp, C. elegans
ttcgaaaatattt

SEQ ID NO: 735400 - DNA, 13 bp, C. elegans
ttcgaaaatcaaa

SEQ ID NO: 735401 - DNA, 13 bp, C. elegans
ttcgaaaatcata

SEQ ID NO: 735402 - DNA, 13 bp, C. elegans
ttcgaaaatgttc

SEQ ID NO: 735403 - DNA, 13 bp, C. elegans
ttcgaaaatgttt

SEQ ID NO: 735404 - DNA, 13 bp, C. elegans
ttcgaaaattaaa

SEQ ID NO: 735405 - DNA, 13 bp, C. elegans
ttcgaaaattaat

SEQ ID NO: 735406 - DNA, 13 bp, C. elegans
ttcgaaaattaca

SEQ ID NO: 735407 - DNA, 13 bp, C. elegans
ttcgaaaattata

SEQ ID NO: 735408 - DNA, 13 bp, C. elegans
ttcgaaaattatt

SEQ ID NO: 735409 - DNA, 13 bp, C. elegans
ttcgaaaattcaa

SEQ ID NO: 735410 - DNA, 13 bp, C. elegans
ttcgaaaattcat

SEQ ID NO: 735411 - DNA, 13 bp, C. elegans
ttcgaaaattgaa

SEQ ID NO: 735412 - DNA, 13 bp, C. elegans
ttcgaaaattgcc

SEQ ID NO: 735413 - DNA, 13 bp, C. elegans
ttcgaaaattgtt

SEQ ID NO: 735414 - DNA, 13 bp, C. elegans
ttcgaaacaattc

SEQ ID NO: 735415 - DNA, 13 bp, C. elegans
ttcgaaacaattt

SEQ ID NO: 735416 - DNA, 13 bp, C. elegans
ttcgaaacagtaa

SEQ ID NO: 735417 - DNA, 13 bp, C. elegans
ttcgaaacatttg

SEQ ID NO: 735418 - DNA, 13 bp, C. elegans
ttcgaaacgaaaa

SEQ ID NO: 735419 - DNA, 13 bp, C. elegans
ttcgaaacgtttc

SEQ ID NO: 735420 - DNA, 13 bp, C. elegans
ttcgaaactaaaa

SEQ ID NO: 735421 - DNA, 13 bp, C. elegans
ttcgaaacttttc

SEQ ID NO: 735422 - DNA, 13 bp, C. elegans
ttcgaaagaaaat

SEQ ID NO: 735423 - DNA, 13 bp, C. elegans
ttcgaaagatttt

SEQ ID NO: 735424 - DNA, 13 bp, C. elegans
ttcgaaagttaaa

SEQ ID NO: 735425 - DNA, 13 bp, C. elegans
ttcgaaagttatt

SEQ ID NO: 735426 - DNA, 13 bp, C. elegans
ttcgaaagttgtt

SEQ ID NO: 735427 - DNA, 13 bp, C. elegans
ttcgaaagtttca

SEQ ID NO: 735428 - DNA, 13 bp, C. elegans
ttcgaaagttttt

SEQ ID NO: 735429 - DNA, 13 bp, C. elegans
ttcgaaataaaat

SEQ ID NO: 735430 - DNA, 13 bp, C. elegans
ttcgaaataattt

SEQ ID NO: 735431 - DNA, 13 bp, C. elegans
ttcgaaatatcga

SEQ ID NO: 735432 - DNA, 13 bp, C. elegans
ttcgaaatattca

SEQ ID NO: 735433 - DNA, 13 bp, C. elegans
ttcgaaatatttg

SEQ ID NO: 735434 - DNA, 13 bp, C. elegans
ttcgaaatcgaaa

SEQ ID NO: 735435 - DNA, 13 bp, C. elegans
ttcgaaatctcat

SEQ ID NO: 735436 - DNA, 13 bp, C. elegans
ttcgaaatcttca

SEQ ID NO: 735437 - DNA, 13 bp, C. elegans
ttcgaaatgaaaa

SEQ ID NO: 735438 - DNA, 13 bp, C. elegans
ttcgaaatgaaac

SEQ ID NO: 735439 - DNA, 13 bp, C. elegans
ttcgaaatgtctt

SEQ ID NO: 735440 - DNA, 13 bp, C. elegans
ttcgaaatgttga

SEQ ID NO: 735441 - DNA, 13 bp, C. elegans
ttcgaaatgtttt

SEQ ID NO: 735442 - DNA, 13 bp, C. elegans
ttcgaaattattt

SEQ ID NO: 735443 - DNA, 13 bp, C. elegans
ttcgaaattcaaa

SEQ ID NO: 735444 - DNA, 13 bp, C. elegans
ttcgaaattccaa

SEQ ID NO: 735445 - DNA, 13 bp, C. elegans
ttcgaaattcgaa

SEQ ID NO: 735446 - DNA, 13 bp, C. elegans
ttcgaaattctaa

SEQ ID NO: 735447 - DNA, 13 bp, C. elegans
ttcgaaatttgac

SEQ ID NO: 735448 - DNA, 13 bp, C. elegans
ttcgaaatttgga

SEQ ID NO: 735449 - DNA, 13 bp, C. elegans
ttcgaaattttaa

SEQ ID NO: 735450 - DNA, 13 bp, C. elegans
ttcgaaattttct

SEQ ID NO: 735451 - DNA, 13 bp, C. elegans
ttcgaaatttttc

SEQ ID NO: 735452 - DNA, 13 bp, C. elegans
ttcgaaccaatca

SEQ ID NO: 735453 - DNA, 13 bp, C. elegans
ttcgaacgttttt

SEQ ID NO: 735454 - DNA, 13 bp, C. elegans
ttcgaactaaaaa

SEQ ID NO: 735455 - DNA, 13 bp, C. elegans
ttcgaactttcaa

SEQ ID NO: 735456 - DNA, 13 bp, C. elegans
ttcgaactttttt

SEQ ID NO: 735457 - DNA, 13 bp, C. elegans
ttcgaagaaaatc

SEQ ID NO: 735458 - DNA, 13 bp, C. elegans
ttcgaagaaataa

SEQ ID NO: 735459 - DNA, 13 bp, C. elegans
ttcgaagaatttt

SEQ ID NO: 735460 - DNA, 13 bp, C. elegans
ttcgaagagaaaa

SEQ ID NO: 735461 - DNA, 13 bp, C. elegans
ttcgaagatccaa

SEQ ID NO: 735462 - DNA, 13 bp, C. elegans
ttcgaagtttgaa

SEQ ID NO: 735463 - DNA, 13 bp, C. elegans
ttcgaataaaaat

SEQ ID NO: 735464 - DNA, 13 bp, C. elegans
ttcgaataaaata

SEQ ID NO: 735465 - DNA, 13 bp, C. elegans
ttcgaataaattt

SEQ ID NO: 735466 - DNA, 13 bp, C. elegans
ttcgaataattta

SEQ ID NO: 735467 - DNA, 13 bp, C. elegans
ttcgaataatttt

SEQ ID NO: 735468 - DNA, 13 bp, C. elegans
ttcgaatatttta

SEQ ID NO: 735469 - DNA, 13 bp, C. elegans
ttcgaatattttt

SEQ ID NO: 735470 - DNA, 13 bp, C. elegans
ttcgaatctggat

SEQ ID NO: 735471 - DNA, 13 bp, C. elegans
ttcgaattattca

SEQ ID NO: 735472 - DNA, 13 bp, C. elegans
ttcgaattcaaat

SEQ ID NO: 735473 - DNA, 13 bp, C. elegans
ttcgaattcaatt

SEQ ID NO: 735474 - DNA, 13 bp, C. elegans
ttcgaattcccca

SEQ ID NO: 735475 - DNA, 13 bp, C. elegans
ttcgaattcgaaa

SEQ ID NO: 735476 - DNA, 13 bp, C. elegans
ttcgaattgaaat

SEQ ID NO: 735477 - DNA, 13 bp, C. elegans
ttcgaattgattt

SEQ ID NO: 735478 - DNA, 13 bp, C. elegans
ttcgaattgtttt

SEQ ID NO: 735479 - DNA, 13 bp, C. elegans
ttcgaatttagca

SEQ ID NO: 735480 - DNA, 13 bp, C. elegans
ttcgaatttcccg

SEQ ID NO: 735481 - DNA, 13 bp, C. elegans
ttcgaatttctct

SEQ ID NO: 735482 - DNA, 13 bp, C. elegans
ttcgaatttctta

SEQ ID NO: 735483 - DNA, 13 bp, C. elegans
ttcgaattttaat

SEQ ID NO: 735484 - DNA, 13 bp, C. elegans
ttcgaattttatt

SEQ ID NO: 735485 - DNA, 13 bp, C. elegans
ttcgaattttcaa

SEQ ID NO: 735486 - DNA, 13 bp, C. elegans
ttcgaattttcag

SEQ ID NO: 735487 - DNA, 13 bp, C. elegans
ttcgaattttcat

SEQ ID NO: 735488 - DNA, 13 bp, C. elegans
ttcgaattttcct

SEQ ID NO: 735489 - DNA, 13 bp, C. elegans
ttcgaattttctc

SEQ ID NO: 735490 - DNA, 13 bp, C. elegans
ttcgaattttgat

SEQ ID NO: 735491 - DNA, 13 bp, C. elegans
ttcgaattttgca

SEQ ID NO: 735492 - DNA, 13 bp, C. elegans
ttcgaattttgtc

SEQ ID NO: 735493 - DNA, 13 bp, C. elegans
ttcgaatttttca

SEQ ID NO: 735494 - DNA, 13 bp, C. elegans
ttcgaatttttcc

SEQ ID NO: 735495 - DNA, 13 bp, C. elegans
ttcgaatttttcg

SEQ ID NO: 735496 - DNA, 13 bp, C. elegans
ttcgaatttttgg

SEQ ID NO: 735497 - DNA, 13 bp, C. elegans
ttcgaatttttgt

SEQ ID NO: 735498 - DNA, 13 bp, C. elegans
ttcgacaaattgc

SEQ ID NO: 735499 - DNA, 13 bp, C. elegans
ttcgacaactcct

SEQ ID NO: 735500 - DNA, 13 bp, C. elegans
ttcgacaatttgc

SEQ ID NO: 735501 - DNA, 13 bp, C. elegans
ttcgacacttttt

SEQ ID NO: 735502 - DNA, 13 bp, C. elegans
ttcgacagaaaaa

SEQ ID NO: 735503 - DNA, 13 bp, C. elegans
ttcgacattttta

SEQ ID NO: 735504 - DNA, 13 bp, C. elegans
ttcgaccaaaaaa

SEQ ID NO: 735505 - DNA, 13 bp, C. elegans
ttcgacccaaaaa

SEQ ID NO: 735506 - DNA, 13 bp, C. elegans
ttcgacgaaaaat

SEQ ID NO: 735507 - DNA, 13 bp, C. elegans
ttcgacgaaaatt

SEQ ID NO: 735508 - DNA, 13 bp, C. elegans
ttcgacggaaatt

SEQ ID NO: 735509 - DNA, 13 bp, C. elegans
ttcgactaaaatt

SEQ ID NO: 735510 - DNA, 13 bp, C. elegans
ttcgactcaattg

SEQ ID NO: 735511 - DNA, 13 bp, C. elegans
ttcgactgaaaac

SEQ ID NO: 735512 - DNA, 13 bp, C. elegans
ttcgactgttttt

SEQ ID NO: 735513 - DNA, 13 bp, C. elegans
ttcgacttttttc

SEQ ID NO: 735514 - DNA, 13 bp, C. elegans
ttcgacttttttg

SEQ ID NO: 735515 - DNA, 13 bp, C. elegans
ttcgagaaaaaaa

SEQ ID NO: 735516 - DNA, 13 bp, C. elegans
ttcgagaaaaaca

SEQ ID NO: 735517 - DNA, 13 bp, C. elegans
ttcgagaaaacaa

SEQ ID NO: 735518 - DNA, 13 bp, C. elegans
ttcgagaaaagaa

SEQ ID NO: 735519 - DNA, 13 bp, C. elegans
ttcgagaaaatat

SEQ ID NO: 735520 - DNA, 13 bp, C. elegans
ttcgagaaaattg

SEQ ID NO: 735521 - DNA, 13 bp, C. elegans
ttcgagaaacaaa

SEQ ID NO: 735522 - DNA, 13 bp, C. elegans
ttcgagaaatttt

SEQ ID NO: 735523 - DNA, 13 bp, C. elegans
ttcgagaagtttc

SEQ ID NO: 735524 - DNA, 13 bp, C. elegans
ttcgagaattttg

SEQ ID NO: 735525 - DNA, 13 bp, C. elegans
ttcgagacgtttt

SEQ ID NO: 735526 - DNA, 13 bp, C. elegans
ttcgagactgaag

SEQ ID NO: 735527 - DNA, 13 bp, C. elegans
ttcgagagttttt

SEQ ID NO: 735528 - DNA, 13 bp, C. elegans
ttcgagataaaaa

SEQ ID NO: 735529 - DNA, 13 bp, C. elegans
ttcgagatatttt

SEQ ID NO: 735530 - DNA, 13 bp, C. elegans
ttcgagatttttc

SEQ ID NO: 735531 - DNA, 13 bp, C. elegans
ttcgagatttttt

SEQ ID NO: 735532 - DNA, 13 bp, C. elegans
ttcgagcaatttt

SEQ ID NO: 735533 - DNA, 13 bp, C. elegans
ttcgagcattttc

SEQ ID NO: 735534 - DNA, 13 bp, C. elegans
ttcgagcattttt

SEQ ID NO: 735535 - DNA, 13 bp, C. elegans
ttcgagctaattt

SEQ ID NO: 735536 - DNA, 13 bp, C. elegans
ttcgaggcgaagc

SEQ ID NO: 735537 - DNA, 13 bp, C. elegans
ttcgaggtttttt

SEQ ID NO: 735538 - DNA, 13 bp, C. elegans
ttcgagtgaaaaa

SEQ ID NO: 735539 - DNA, 13 bp, C. elegans
ttcgagtttattt

SEQ ID NO: 735540 - DNA, 13 bp, C. elegans
ttcgagttttaaa

SEQ ID NO: 735541 - DNA, 13 bp, C. elegans
ttcgagttttgtt

SEQ ID NO: 735542 - DNA, 13 bp, C. elegans
ttcgataaatgtt

SEQ ID NO: 735543 - DNA, 13 bp, C. elegans
ttcgataaatttg

SEQ ID NO: 735544 - DNA, 13 bp, C. elegans
ttcgataatttat

SEQ ID NO: 735545 - DNA, 13 bp, C. elegans
ttcgatagaagaa

SEQ ID NO: 735546 - DNA, 13 bp, C. elegans
ttcgatagttttt

SEQ ID NO: 735547 - DNA, 13 bp, C. elegans
ttcgatatattta

SEQ ID NO: 735548 - DNA, 13 bp, C. elegans
ttcgatattttct

SEQ ID NO: 735549 - DNA, 13 bp, C. elegans
ttcgatcaaaaac

SEQ ID NO: 735550 - DNA, 13 bp, C. elegans
ttcgatcaatttt

SEQ ID NO: 735551 - DNA, 13 bp, C. elegans
ttcgatctatttt

SEQ ID NO: 735552 - DNA, 13 bp, C. elegans
ttcgatgagaaaa

SEQ ID NO: 735553 - DNA, 13 bp, C. elegans
ttcgatgcaaaaa

SEQ ID NO: 735554 - DNA, 13 bp, C. elegans
ttcgatgcaccat

SEQ ID NO: 735555 - DNA, 13 bp, C. elegans
ttcgatggtcttc

SEQ ID NO: 735556 - DNA, 13 bp, C. elegans
ttcgattaaaaaa

SEQ ID NO: 735557 - DNA, 13 bp, C. elegans
ttcgattaaaaag

SEQ ID NO: 735558 - DNA, 13 bp, C. elegans
ttcgattattttg

SEQ ID NO: 735559 - DNA, 13 bp, C. elegans
ttcgattcatttt

SEQ ID NO: 735560 - DNA, 13 bp, C. elegans
ttcgattggtttt

SEQ ID NO: 735561 - DNA, 13 bp, C. elegans
ttcgattgttttg

SEQ ID NO: 735562 - DNA, 13 bp, C. elegans
ttcgatttaataa

SEQ ID NO: 735563 - DNA, 13 bp, C. elegans
ttcgatttagcag

SEQ ID NO: 735564 - DNA, 13 bp, C. elegans
ttcgatttatgaa

SEQ ID NO: 735565 - DNA, 13 bp, C. elegans
ttcgatttatttg

SEQ ID NO: 735566 - DNA, 13 bp, C. elegans
ttcgatttcaaat

SEQ ID NO: 735567 - DNA, 13 bp, C. elegans
ttcgatttccaaa

SEQ ID NO: 735568 - DNA, 13 bp, C. elegans
ttcgatttcttcg

SEQ ID NO: 735569 - DNA, 13 bp, C. elegans
ttcgatttgaaaa

SEQ ID NO: 735570 - DNA, 13 bp, C. elegans
ttcgatttgaata

SEQ ID NO: 735571 - DNA, 13 bp, C. elegans
ttcgattttataa

SEQ ID NO: 735572 - DNA, 13 bp, C. elegans
ttcgattttatca

SEQ ID NO: 735573 - DNA, 13 bp, C. elegans
ttcgattttcaag

SEQ ID NO: 735574 - DNA, 13 bp, C. elegans
ttcgattttccac

SEQ ID NO: 735575 - DNA, 13 bp, C. elegans
ttcgattttccag

SEQ ID NO: 735576 - DNA, 13 bp, C. elegans
ttcgattttcctt

SEQ ID NO: 735577 - DNA, 13 bp, C. elegans
ttcgattttcgaa

SEQ ID NO: 735578 - DNA, 13 bp, C. elegans
ttcgattttctat

SEQ ID NO: 735579 - DNA, 13 bp, C. elegans
ttcgattttctta

SEQ ID NO: 735580 - DNA, 13 bp, C. elegans
ttcgattttggaa

SEQ ID NO: 735581 - DNA, 13 bp, C. elegans
ttcgatttttaaa

SEQ ID NO: 735582 - DNA, 13 bp, C. elegans
ttcgatttttaag

SEQ ID NO: 735583 - DNA, 13 bp, C. elegans
ttcgatttttaga

SEQ ID NO: 735584 - DNA, 13 bp, C. elegans
ttcgatttttata

SEQ ID NO: 735585 - DNA, 13 bp, C. elegans
ttcgatttttatg

SEQ ID NO: 735586 - DNA, 13 bp, C. elegans
ttcgatttttcaa

SEQ ID NO: 735587 - DNA, 13 bp, C. elegans
ttcgatttttcca

SEQ ID NO: 735588 - DNA, 13 bp, C. elegans
ttcgatttttctc

SEQ ID NO: 735589 - DNA, 13 bp, C. elegans
ttcgatttttctg

SEQ ID NO: 735590 - DNA, 13 bp, C. elegans
ttcgattttttcc

SEQ ID NO: 735591 - DNA, 13 bp, C. elegans
ttcgcaaaaatca

SEQ ID NO: 735592 - DNA, 13 bp, C. elegans
ttcgcaaaacttt

SEQ ID NO: 735593 - DNA, 13 bp, C. elegans
ttcgcaaagttga

SEQ ID NO: 735594 - DNA, 13 bp, C. elegans
ttcgcaacactgc

SEQ ID NO: 735595 - DNA, 13 bp, C. elegans
ttcgcaaccaccg

SEQ ID NO: 735596 - DNA, 13 bp, C. elegans
ttcgcaatttaaa

SEQ ID NO: 735597 - DNA, 13 bp, C. elegans
ttcgcaattttca

SEQ ID NO: 735598 - DNA, 13 bp, C. elegans
ttcgcaatttttc

SEQ ID NO: 735599 - DNA, 13 bp, C. elegans
ttcgcagaaaaaa

SEQ ID NO: 735600 - DNA, 13 bp, C. elegans
ttcgcagtttttc

SEQ ID NO: 735601 - DNA, 13 bp, C. elegans
ttcgcatagtttt

SEQ ID NO: 735602 - DNA, 13 bp, C. elegans
ttcgcatattttt

SEQ ID NO: 735603 - DNA, 13 bp, C. elegans
ttcgcattaaaaa

SEQ ID NO: 735604 - DNA, 13 bp, C. elegans
ttcgcatttattt

SEQ ID NO: 735605 - DNA, 13 bp, C. elegans
ttcgcattttcaa

SEQ ID NO: 735606 - DNA, 13 bp, C. elegans
ttcgccaaacttt

SEQ ID NO: 735607 - DNA, 13 bp, C. elegans
ttcgccaatttta

SEQ ID NO: 735608 - DNA, 13 bp, C. elegans
ttcgccaattttc

SEQ ID NO: 735609 - DNA, 13 bp, C. elegans
ttcgccgaaaaaa

SEQ ID NO: 735610 - DNA, 13 bp, C. elegans
ttcgccgaattca

SEQ ID NO: 735611 - DNA, 13 bp, C. elegans
ttcgccgaattgc

SEQ ID NO: 735612 - DNA, 13 bp, C. elegans
ttcgcgaattttc

SEQ ID NO: 735613 - DNA, 13 bp, C. elegans
ttcgcgatttttt

SEQ ID NO: 735614 - DNA, 13 bp, C. elegans
ttcgcgccaattt

SEQ ID NO: 735615 - DNA, 13 bp, C. elegans
ttcgcgcgcgcgc

SEQ ID NO: 735616 - DNA, 13 bp, C. elegans
ttcgcgttttcgt

SEQ ID NO: 735617 - DNA, 13 bp, C. elegans
ttcgctaaatttt

SEQ ID NO: 735618 - DNA, 13 bp, C. elegans
ttcgctacgaaat

SEQ ID NO: 735619 - DNA, 13 bp, C. elegans
ttcgctacgggat

SEQ ID NO: 735620 - DNA, 13 bp, C. elegans
ttcgctgaaaact

SEQ ID NO: 735621 - DNA, 13 bp, C. elegans
ttcgctgaaaatt

SEQ ID NO: 735622 - DNA, 13 bp, C. elegans
ttcgctgattttc

SEQ ID NO: 735623 - DNA, 13 bp, C. elegans
ttcgcttcaaaaa

SEQ ID NO: 735624 - DNA, 13 bp, C. elegans
ttcgcttgaaatt

SEQ ID NO: 735625 - DNA, 13 bp, C. elegans
ttcggaaaaatct

SEQ ID NO: 735626 - DNA, 13 bp, C. elegans
ttcggaaaaattt

SEQ ID NO: 735627 - DNA, 13 bp, C. elegans
ttcggaaaacaaa

SEQ ID NO: 735628 - DNA, 13 bp, C. elegans
ttcggaaaagaaa

SEQ ID NO: 735629 - DNA, 13 bp, C. elegans
ttcggaaaagtgt

SEQ ID NO: 735630 - DNA, 13 bp, C. elegans
ttcggaaaagttc

SEQ ID NO: 735631 - DNA, 13 bp, C. elegans
ttcggaaaagttt

SEQ ID NO: 735632 - DNA, 13 bp, C. elegans
ttcggaaaatgtt

SEQ ID NO: 735633 - DNA, 13 bp, C. elegans
ttcggaaaattat

SEQ ID NO: 735634 - DNA, 13 bp, C. elegans
ttcggaaaattca

SEQ ID NO: 735635 - DNA, 13 bp, C. elegans
ttcggaaaattta

SEQ ID NO: 735636 - DNA, 13 bp, C. elegans
ttcggaaattgaa

SEQ ID NO: 735637 - DNA, 13 bp, C. elegans
ttcggaaatttgc

SEQ ID NO: 735638 - DNA, 13 bp, C. elegans
ttcggaacattcc

SEQ ID NO: 735639 - DNA, 13 bp, C. elegans
ttcggaagaaaat

SEQ ID NO: 735640 - DNA, 13 bp, C. elegans
ttcggaataaaat

SEQ ID NO: 735641 - DNA, 13 bp, C. elegans
ttcggaatcagga

SEQ ID NO: 735642 - DNA, 13 bp, C. elegans
ttcggaatcttgt

SEQ ID NO: 735643 - DNA, 13 bp, C. elegans
ttcggaatttcaa

SEQ ID NO: 735644 - DNA, 13 bp, C. elegans
ttcggaattttga

SEQ ID NO: 735645 - DNA, 13 bp, C. elegans
ttcggacaatttt

SEQ ID NO: 735646 - DNA, 13 bp, C. elegans
ttcggacagatgt

SEQ ID NO: 735647 - DNA, 13 bp, C. elegans
ttcggacattttt

SEQ ID NO: 735648 - DNA, 13 bp, C. elegans
ttcggagaaaaat

SEQ ID NO: 735649 - DNA, 13 bp, C. elegans
ttcggagatcaat

SEQ ID NO: 735650 - DNA, 13 bp, C. elegans
ttcggagcatttt

SEQ ID NO: 735651 - DNA, 13 bp, C. elegans
ttcggaggaaatt

SEQ ID NO: 735652 - DNA, 13 bp, C. elegans
ttcggagtgtcgt

SEQ ID NO: 735653 - DNA, 13 bp, C. elegans
ttcggagtttttt

SEQ ID NO: 735654 - DNA, 13 bp, C. elegans
ttcggatgattgg

SEQ ID NO: 735655 - DNA, 13 bp, C. elegans
ttcggatgctgat

SEQ ID NO: 735656 - DNA, 13 bp, C. elegans
ttcggatttttta

SEQ ID NO: 735657 - DNA, 13 bp, C. elegans
ttcggcaaaccgg

SEQ ID NO: 735658 - DNA, 13 bp, C. elegans
ttcggcaaattac

SEQ ID NO: 735659 - DNA, 13 bp, C. elegans
ttcggcaaatttg

SEQ ID NO: 735660 - DNA, 14 bp, C. elegans
ttcggcaaccggca

SEQ ID NO: 735661 - DNA, 13 bp, C. elegans
ttcggcaactgcc

SEQ ID NO: 735662 - DNA, 13 bp, C. elegans
ttcggcaattgtc

SEQ ID NO: 735663 - DNA, 13 bp, C. elegans
ttcggcaattttt

SEQ ID NO: 735664 - DNA, 13 bp, C. elegans
ttcggcattttga

SEQ ID NO: 735665 - DNA, 13 bp, C. elegans
ttcggccaaattt

SEQ ID NO: 735666 - DNA, 13 bp, C. elegans
ttcggccaccgat

SEQ ID NO: 735667 - DNA, 13 bp, C. elegans
ttcggcgcaaaaa

SEQ ID NO: 735668 - DNA, 13 bp, C. elegans
ttcggcgtttttc

SEQ ID NO: 735669 - DNA, 13 bp, C. elegans
ttcggctgaaaaa

SEQ ID NO: 735670 - DNA, 13 bp, C. elegans
ttcggcttattag

SEQ ID NO: 735671 - DNA, 13 bp, C. elegans
ttcgggaaattat

SEQ ID NO: 735672 - DNA, 13 bp, C. elegans
ttcgggaatttta

SEQ ID NO: 735673 - DNA, 13 bp, C. elegans
ttcggggaaaaat

SEQ ID NO: 735674 - DNA, 13 bp, C. elegans
ttcggtactccac

SEQ ID NO: 735675 - DNA, 13 bp, C. elegans
ttcggtcaatttt

SEQ ID NO: 735676 - DNA, 13 bp, C. elegans
ttcggtgaaattt

SEQ ID NO: 735677 - DNA, 13 bp, C. elegans
ttcggtgttttca

SEQ ID NO: 735678 - DNA, 13 bp, C. elegans
ttcggtttttgaa

SEQ ID NO: 735679 - DNA, 13 bp, C. elegans
ttcggttttttaa

SEQ ID NO: 735680 - DNA, 13 bp, C. elegans
ttcggttttttca

SEQ ID NO: 735681 - DNA, 13 bp, C. elegans
ttcgtaaaaaatt

SEQ ID NO: 735682 - DNA, 13 bp, C. elegans
ttcgtaaaattca

SEQ ID NO: 735683 - DNA, 13 bp, C. elegans
ttcgtaaaattcg

SEQ ID NO: 735684 - DNA, 13 bp, C. elegans
ttcgtaatatttt

SEQ ID NO: 735685 - DNA, 13 bp, C. elegans
ttcgtaatgaaaa

SEQ ID NO: 735686 - DNA, 13 bp, C. elegans
ttcgtaatgaaac

SEQ ID NO: 735687 - DNA, 13 bp, C. elegans
ttcgtagatcaaa

SEQ ID NO: 735688 - DNA, 13 bp, C. elegans
ttcgtagtatttt

SEQ ID NO: 735689 - DNA, 13 bp, C. elegans
ttcgtatacattt

SEQ ID NO: 735690 - DNA, 13 bp, C. elegans
ttcgtatattttc

SEQ ID NO: 735691 - DNA, 13 bp, C. elegans
ttcgtattaattt

SEQ ID NO: 735692 - DNA, 13 bp, C. elegans
ttcgtcaaaaaaa

SEQ ID NO: 735693 - DNA, 13 bp, C. elegans
ttcgtcaattttc

SEQ ID NO: 735694 - DNA, 13 bp, C. elegans
ttcgtcacatttt

SEQ ID NO: 735695 - DNA, 13 bp, C. elegans
ttcgtcatcacat

SEQ ID NO: 735696 - DNA, 13 bp, C. elegans
ttcgtcatttttg

SEQ ID NO: 735697 - DNA, 13 bp, C. elegans
ttcgtcccaaaaa

SEQ ID NO: 735698 - DNA, 13 bp, C. elegans
ttcgtcgaaaaat

SEQ ID NO: 735699 - DNA, 13 bp, C. elegans
ttcgtctaaattt

SEQ ID NO: 735700 - DNA, 13 bp, C. elegans
ttcgtctcatttt

SEQ ID NO: 735701 - DNA, 13 bp, C. elegans
ttcgtctgaaatt

SEQ ID NO: 735702 - DNA, 13 bp, C. elegans
ttcgtctgatttt

SEQ ID NO: 735703 - DNA, 13 bp, C. elegans
ttcgtctgtcaat

SEQ ID NO: 735704 - DNA, 13 bp, C. elegans
ttcgtgaaaaata

SEQ ID NO: 735705 - DNA, 13 bp, C. elegans
ttcgtgaatttct

SEQ ID NO: 735706 - DNA, 13 bp, C. elegans
ttcgtgatatttt

SEQ ID NO: 735707 - DNA, 13 bp, C. elegans
ttcgtgatgagac

SEQ ID NO: 735708 - DNA, 13 bp, C. elegans
ttcgtgatttttg

SEQ ID NO: 735709 - DNA, 13 bp, C. elegans
ttcgtgcaatttt

SEQ ID NO: 735710 - DNA, 13 bp, C. elegans
ttcgtggaaaatt

SEQ ID NO: 735711 - DNA, 13 bp, C. elegans
ttcgtggaatttt

SEQ ID NO: 735712 - DNA, 13 bp, C. elegans
ttcgtggattttt

SEQ ID NO: 735713 - DNA, 13 bp, C. elegans
ttcgtggcaagac

SEQ ID NO: 735714 - DNA, 13 bp, C. elegans
ttcgtggcaggac

SEQ ID NO: 735715 - DNA, 13 bp, C. elegans
ttcgtggtaggac

SEQ ID NO: 735716 - DNA, 13 bp, C. elegans
ttcgtgtaaaaat

SEQ ID NO: 735717 - DNA, 13 bp, C. elegans
ttcgtgtcaaaaa

SEQ ID NO: 735718 - DNA, 13 bp, C. elegans
ttcgtgtcaattt

SEQ ID NO: 735719 - DNA, 13 bp, C. elegans
ttcgtgtttttca

SEQ ID NO: 735720 - DNA, 13 bp, C. elegans
ttcgttaaaaaaa

SEQ ID NO: 735721 - DNA, 13 bp, C. elegans
ttcgttcaaaaat

SEQ ID NO: 735722 - DNA, 13 bp, C. elegans
ttcgttcaaaata

SEQ ID NO: 735723 - DNA, 13 bp, C. elegans
ttcgttcattttc

SEQ ID NO: 735724 - DNA, 13 bp, C. elegans
ttcgttccaaaaa

SEQ ID NO: 735725 - DNA, 13 bp, C. elegans
ttcgttgaaaact

SEQ ID NO: 735726 - DNA, 13 bp, C. elegans
ttcgttgatttaa

SEQ ID NO: 735727 - DNA, 13 bp, C. elegans
ttcgttgttttaa

SEQ ID NO: 735728 - DNA, 13 bp, C. elegans
ttcgtttaaattt

SEQ ID NO: 735729 - DNA, 13 bp, C. elegans
ttcgtttcaattt

SEQ ID NO: 735730 - DNA, 13 bp, C. elegans
ttcgtttcgaaaa

SEQ ID NO: 735731 - DNA, 13 bp, C. elegans
ttcgtttgaaaaa

SEQ ID NO: 735732 - DNA, 13 bp, C. elegans
ttcgttttccgat

SEQ ID NO: 735733 - DNA, 13 bp, C. elegans
ttcgtttttatca

SEQ ID NO: 735734 - DNA, 13 bp, C. elegans
ttcgtttttcaaa

SEQ ID NO: 735735 - DNA, 13 bp, C. elegans
ttcgtttttcaga

SEQ ID NO: 735736 - DNA, 13 bp, C. elegans
ttcgtttttctca

SEQ ID NO: 735737 - DNA, 13 bp, C. elegans
ttcgttttttcaa

SEQ ID NO: 735738 - DNA, 13 bp, C. elegans
ttcgttttttcga

SEQ ID NO: 735739 - DNA, 13 bp, C. elegans
ttctaaaaaagtt

SEQ ID NO: 735740 - DNA, 13 bp, C. elegans
ttctaaaaaatca

SEQ ID NO: 735741 - DNA, 13 bp, C. elegans
ttctaaaaaattc

SEQ ID NO: 735742 - DNA, 13 bp, C. elegans
ttctaaaaacatt

SEQ ID NO: 735743 - DNA, 13 bp, C. elegans
ttctaaaaacctg

SEQ ID NO: 735744 - DNA, 13 bp, C. elegans
ttctaaaaactaa

SEQ ID NO: 735745 - DNA, 13 bp, C. elegans
ttctaaaaactga

SEQ ID NO: 735746 - DNA, 13 bp, C. elegans
ttctaaaaagaag

SEQ ID NO: 735747 - DNA, 13 bp, C. elegans
ttctaaaactctt

SEQ ID NO: 735748 - DNA, 13 bp, C. elegans
ttctaaaactgaa

SEQ ID NO: 735749 - DNA, 13 bp, C. elegans
ttctaaaacttga

SEQ ID NO: 735750 - DNA, 13 bp, C. elegans
ttctaaaagtgat

SEQ ID NO: 735751 - DNA, 13 bp, C. elegans
ttctaaaagtttc

SEQ ID NO: 735752 - DNA, 13 bp, C. elegans
ttctaaaatatca

SEQ ID NO: 735753 - DNA, 13 bp, C. elegans
ttctaaaatcaaa

SEQ ID NO: 735754 - DNA, 13 bp, C. elegans
ttctaaaatccaa

SEQ ID NO: 735755 - DNA, 13 bp, C. elegans
ttctaaaatgaat

SEQ ID NO: 735756 - DNA, 13 bp, C. elegans
ttctaaaatggaa

SEQ ID NO: 735757 - DNA, 13 bp, C. elegans
ttctaaaattcta

SEQ ID NO: 735758 - DNA, 13 bp, C. elegans
ttctaaaattgct

SEQ ID NO: 735759 - DNA, 13 bp, C. elegans
ttctaaaattttc

SEQ ID NO: 735760 - DNA, 13 bp, C. elegans
ttctaaaattttg

SEQ ID NO: 735761 - DNA, 13 bp, C. elegans
ttctaaacatttt

SEQ ID NO: 735762 - DNA, 13 bp, C. elegans
ttctaaactttta

SEQ ID NO: 735763 - DNA, 13 bp, C. elegans
ttctaaagaaaaa

SEQ ID NO: 735764 - DNA, 13 bp, C. elegans
ttctaaagaaata

SEQ ID NO: 735765 - DNA, 13 bp, C. elegans
ttctaaagttttg

SEQ ID NO: 735766 - DNA, 13 bp, C. elegans
ttctaaataattg

SEQ ID NO: 735767 - DNA, 13 bp, C. elegans
ttctaaatacttt

SEQ ID NO: 735768 - DNA, 13 bp, C. elegans
ttctaaatctaaa

SEQ ID NO: 735769 - DNA, 13 bp, C. elegans
ttctaaatgattt

SEQ ID NO: 735770 - DNA, 13 bp, C. elegans
ttctaaatgttct

SEQ ID NO: 735771 - DNA, 13 bp, C. elegans
ttctaaatgtttt

SEQ ID NO: 735772 - DNA, 13 bp, C. elegans
ttctaaattattg

SEQ ID NO: 735773 - DNA, 13 bp, C. elegans
ttctaaattctat

SEQ ID NO: 735774 - DNA, 13 bp, C. elegans
ttctaaattctta

SEQ ID NO: 735775 - DNA, 13 bp, C. elegans
ttctaaattgttt

SEQ ID NO: 735776 - DNA, 13 bp, C. elegans
ttctaaatttaca

SEQ ID NO: 735777 - DNA, 13 bp, C. elegans
ttctaaatttcaa

SEQ ID NO: 735778 - DNA, 13 bp, C. elegans
ttctaaatttcct

SEQ ID NO: 735779 - DNA, 13 bp, C. elegans
ttctaaattttca

SEQ ID NO: 735780 - DNA, 13 bp, C. elegans
ttctaaattttgt

SEQ ID NO: 735781 - DNA, 13 bp, C. elegans
ttctaacaataag

SEQ ID NO: 735782 - DNA, 13 bp, C. elegans
ttctaaccaaaaa

SEQ ID NO: 735783 - DNA, 13 bp, C. elegans
ttctaaccatttt

SEQ ID NO: 735784 - DNA, 13 bp, C. elegans
ttctaacccaaaa

SEQ ID NO: 735785 - DNA, 13 bp, C. elegans
ttctaacttttgt

SEQ ID NO: 735786 - DNA, 13 bp, C. elegans
ttctaagaaaaaa

SEQ ID NO: 735787 - DNA, 13 bp, C. elegans
ttctaagaaattc

SEQ ID NO: 735788 - DNA, 13 bp, C. elegans
ttctaagcttttt

SEQ ID NO: 735789 - DNA, 13 bp, C. elegans
ttctaagtttatt

SEQ ID NO: 735790 - DNA, 13 bp, C. elegans
ttctaagtttcaa

SEQ ID NO: 735791 - DNA, 13 bp, C. elegans
ttctaataaagct

SEQ ID NO: 735792 - DNA, 13 bp, C. elegans
ttctaataattca

SEQ ID NO: 735793 - DNA, 13 bp, C. elegans
ttctaatacaatt

SEQ ID NO: 735794 - DNA, 13 bp, C. elegans
ttctaatagtaag

SEQ ID NO: 735795 - DNA, 13 bp, C. elegans
ttctaatagtttt

SEQ ID NO: 735796 - DNA, 13 bp, C. elegans
ttctaatcaaatt

SEQ ID NO: 735797 - DNA, 13 bp, C. elegans
ttctaattaacat

SEQ ID NO: 735798 - DNA, 13 bp, C. elegans
ttctaattagaaa

SEQ ID NO: 735799 - DNA, 13 bp, C. elegans
ttctaattctgaa

SEQ ID NO: 735800 - DNA, 13 bp, C. elegans
ttctaattgaaaa

SEQ ID NO: 735801 - DNA, 13 bp, C. elegans
ttctaattgtaag

SEQ ID NO: 735802 - DNA, 13 bp, C. elegans
ttctaattgttaa

SEQ ID NO: 735803 - DNA, 13 bp, C. elegans
ttctaattgtttc

SEQ ID NO: 735804 - DNA, 13 bp, C. elegans
ttctaatttcaaa

SEQ ID NO: 735805 - DNA, 13 bp, C. elegans
ttctaatttcaat

SEQ ID NO: 735806 - DNA, 13 bp, C. elegans
ttctaatttcagt

SEQ ID NO: 735807 - DNA, 13 bp, C. elegans
ttctaatttctgt

SEQ ID NO: 735808 - DNA, 13 bp, C. elegans
ttctaatttgaat

SEQ ID NO: 735809 - DNA, 13 bp, C. elegans
ttctaatttgttc

SEQ ID NO: 735810 - DNA, 13 bp, C. elegans
ttctaattttcgt

SEQ ID NO: 735811 - DNA, 13 bp, C. elegans
ttctacaaaaaat

SEQ ID NO: 735812 - DNA, 13 bp, C. elegans
ttctacaaaaacc

SEQ ID NO: 735813 - DNA, 13 bp, C. elegans
ttctacaaaactc

SEQ ID NO: 735814 - DNA, 13 bp, C. elegans
ttctacaaaactg

SEQ ID NO: 735815 - DNA, 13 bp, C. elegans
ttctacaaaatgt

SEQ ID NO: 735816 - DNA, 13 bp, C. elegans
ttctacaaattat

SEQ ID NO: 735817 - DNA, 13 bp, C. elegans
ttctacaaattca

SEQ ID NO: 735818 - DNA, 13 bp, C. elegans
ttctacaaattta

SEQ ID NO: 735819 - DNA, 13 bp, C. elegans
ttctacaagtttt

SEQ ID NO: 735820 - DNA, 13 bp, C. elegans
ttctacaataact

SEQ ID NO: 735821 - DNA, 13 bp, C. elegans
ttctacaatgttt

SEQ ID NO: 735822 - DNA, 13 bp, C. elegans
ttctacaatttca

SEQ ID NO: 735823 - DNA, 13 bp, C. elegans
ttctacaatttct

SEQ ID NO: 735824 - DNA, 13 bp, C. elegans
ttctacaatttga

SEQ ID NO: 735825 - DNA, 13 bp, C. elegans
ttctacaatttgt

SEQ ID NO: 735826 - DNA, 13 bp, C. elegans
ttctacactgaaa

SEQ ID NO: 735827 - DNA, 13 bp, C. elegans
ttctacactttta

SEQ ID NO: 735828 - DNA, 13 bp, C. elegans
ttctacagaaaaa

SEQ ID NO: 735829 - DNA, 13 bp, C. elegans
ttctacagtaacc

SEQ ID NO: 735830 - DNA, 13 bp, C. elegans
ttctacagtaccc

SEQ ID NO: 735831 - DNA, 13 bp, C. elegans
ttctacataattt

SEQ ID NO: 735832 - DNA, 13 bp, C. elegans
ttctacatgaaaa

SEQ ID NO: 735833 - DNA, 13 bp, C. elegans
ttctacattaaaa

SEQ ID NO: 735834 - DNA, 13 bp, C. elegans
ttctacattttca

SEQ ID NO: 735835 - DNA, 13 bp, C. elegans
ttctaccaaattt

SEQ ID NO: 735836 - DNA, 13 bp, C. elegans
ttctacccaaaaa

SEQ ID NO: 735837 - DNA, 13 bp, C. elegans
ttctaccgatttt

SEQ ID NO: 735838 - DNA, 13 bp, C. elegans
ttctactaaaaac

SEQ ID NO: 735839 - DNA, 13 bp, C. elegans
ttctactcgaaaa

SEQ ID NO: 735840 - DNA, 13 bp, C. elegans
ttctactgaaaat

SEQ ID NO: 735841 - DNA, 13 bp, C. elegans
ttctactgtttca

SEQ ID NO: 735842 - DNA, 13 bp, C. elegans
ttctacttcaaaa

SEQ ID NO: 735843 - DNA, 13 bp, C. elegans
ttctacttgaaaa

SEQ ID NO: 735844 - DNA, 13 bp, C. elegans
ttctactttgaca

SEQ ID NO: 735845 - DNA, 13 bp, C. elegans
ttctacttttcag

SEQ ID NO: 735846 - DNA, 13 bp, C. elegans
ttctagaaaaatc

SEQ ID NO: 735847 - DNA, 13 bp, C. elegans
ttctagaaaaatt

SEQ ID NO: 735848 - DNA, 13 bp, C. elegans
ttctagaaaataa

SEQ ID NO: 735849 - DNA, 13 bp, C. elegans
ttctagaaaattg

SEQ ID NO: 735850 - DNA, 13 bp, C. elegans
ttctagaaacttt

SEQ ID NO: 735851 - DNA, 13 bp, C. elegans
ttctagaaatatc

SEQ ID NO: 735852 - DNA, 13 bp, C. elegans
ttctagaaatcaa

SEQ ID NO: 735853 - DNA, 13 bp, C. elegans
ttctagaaatttc

SEQ ID NO: 735854 - DNA, 13 bp, C. elegans
ttctagaacaatc

SEQ ID NO: 735855 - DNA, 13 bp, C. elegans
ttctagaactttc

SEQ ID NO: 735856 - DNA, 13 bp, C. elegans
ttctagaagcttc

SEQ ID NO: 735857 - DNA, 13 bp, C. elegans
ttctagaatattc

SEQ ID NO: 735858 - DNA, 13 bp, C. elegans
ttctagaattttc

SEQ ID NO: 735859 - DNA, 13 bp, C. elegans
ttctagaattttt

SEQ ID NO: 735860 - DNA, 13 bp, C. elegans
ttctagacatttt

SEQ ID NO: 735861 - DNA, 13 bp, C. elegans
ttctagactgttc

SEQ ID NO: 735862 - DNA, 13 bp, C. elegans
ttctagatcaaaa

SEQ ID NO: 735863 - DNA, 13 bp, C. elegans
ttctagatttatt

SEQ ID NO: 735864 - DNA, 13 bp, C. elegans
ttctagattttta

SEQ ID NO: 735865 - DNA, 13 bp, C. elegans
ttctagcaatttt

SEQ ID NO: 735866 - DNA, 13 bp, C. elegans
ttctagcagtttt

SEQ ID NO: 735867 - DNA, 13 bp, C. elegans
ttctagctcaaaa

SEQ ID NO: 735868 - DNA, 13 bp, C. elegans
ttctagctttaaa

SEQ ID NO: 735869 - DNA, 13 bp, C. elegans
ttctaggactttt

SEQ ID NO: 735870 - DNA, 13 bp, C. elegans
ttctagtgaaaaa

SEQ ID NO: 735871 - DNA, 13 bp, C. elegans
ttctagtgaaatt

SEQ ID NO: 735872 - DNA, 13 bp, C. elegans
ttctagtgatttt

SEQ ID NO: 735873 - DNA, 13 bp, C. elegans
ttctagttgaaat

SEQ ID NO: 735874 - DNA, 13 bp, C. elegans
ttctagtttctaa

SEQ ID NO: 735875 - DNA, 13 bp, C. elegans
ttctagttttgta

SEQ ID NO: 735876 - DNA, 13 bp, C. elegans
ttctagtttttaa

SEQ ID NO: 735877 - DNA, 13 bp, C. elegans
ttctataaaatct

SEQ ID NO: 735878 - DNA, 13 bp, C. elegans
ttctataacatct

SEQ ID NO: 735879 - DNA, 13 bp, C. elegans
ttctatacaaaat

SEQ ID NO: 735880 - DNA, 13 bp, C. elegans
ttctatagaaaat

SEQ ID NO: 735881 - DNA, 13 bp, C. elegans
ttctatagttttg

SEQ ID NO: 735882 - DNA, 13 bp, C. elegans
ttctatatgaaaa

SEQ ID NO: 735883 - DNA, 13 bp, C. elegans
ttctatatttcaa

SEQ ID NO: 735884 - DNA, 13 bp, C. elegans
ttctatatttgat

SEQ ID NO: 735885 - DNA, 13 bp, C. elegans
ttctatattttga

SEQ ID NO: 735886 - DNA, 13 bp, C. elegans
ttctatcaaaatc

SEQ ID NO: 735887 - DNA, 13 bp, C. elegans
ttctatcaaattt

SEQ ID NO: 735888 - DNA, 13 bp, C. elegans
ttctatcaattta

SEQ ID NO: 735889 - DNA, 13 bp, C. elegans
ttctatcaatttc

SEQ ID NO: 735890 - DNA, 13 bp, C. elegans
ttctatcagaaaa

SEQ ID NO: 735891 - DNA, 13 bp, C. elegans
ttctatcatcatt

SEQ ID NO: 735892 - DNA, 13 bp, C. elegans
ttctatcgatttt

SEQ ID NO: 735893 - DNA, 13 bp, C. elegans
ttctatgaaaaag

SEQ ID NO: 735894 - DNA, 13 bp, C. elegans
ttctatgtaaatt

SEQ ID NO: 735895 - DNA, 13 bp, C. elegans
ttctatgtgtatt

SEQ ID NO: 735896 - DNA, 13 bp, C. elegans
ttctattcaaaat

SEQ ID NO: 735897 - DNA, 13 bp, C. elegans
ttctattcagaaa

SEQ ID NO: 735898 - DNA, 13 bp, C. elegans
ttctattcgaatc

SEQ ID NO: 735899 - DNA, 13 bp, C. elegans
ttctattgaaaaa

SEQ ID NO: 735900 - DNA, 13 bp, C. elegans
ttctattgagatg

SEQ ID NO: 735901 - DNA, 13 bp, C. elegans
ttctattggaaaa

SEQ ID NO: 735902 - DNA, 13 bp, C. elegans
ttctattgtttca

SEQ ID NO: 735903 - DNA, 13 bp, C. elegans
ttctatttcaaaa

SEQ ID NO: 735904 - DNA, 13 bp, C. elegans
ttctatttcttcg

SEQ ID NO: 735905 - DNA, 13 bp, C. elegans
ttctattttagaa

SEQ ID NO: 735906 - DNA, 13 bp, C. elegans
ttctattttcaaa

SEQ ID NO: 735907 - DNA, 13 bp, C. elegans
ttctattttggaa

SEQ ID NO: 735908 - DNA, 13 bp, C. elegans
ttctcaaaaaatg

SEQ ID NO: 735909 - DNA, 13 bp, C. elegans
ttctcaaaaaatt

SEQ ID NO: 735910 - DNA, 13 bp, C. elegans
ttctcaaaaacct

SEQ ID NO: 735911 - DNA, 13 bp, C. elegans
ttctcaaaaagtg

SEQ ID NO: 735912 - DNA, 13 bp, C. elegans
ttctcaaaaatat

SEQ ID NO: 735913 - DNA, 13 bp, C. elegans
ttctcaaaaatgc

SEQ ID NO: 735914 - DNA, 13 bp, C. elegans
ttctcaaaacaaa

SEQ ID NO: 735915 - DNA, 13 bp, C. elegans
ttctcaaaacatt

SEQ ID NO: 735916 - DNA, 13 bp, C. elegans
ttctcaaaacgtt

SEQ ID NO: 735917 - DNA, 13 bp, C. elegans
ttctcaaaactct

SEQ ID NO: 735918 - DNA, 13 bp, C. elegans
ttctcaaaacttc

SEQ ID NO: 735919 - DNA, 13 bp, C. elegans
ttctcaaaatatg

SEQ ID NO: 735920 - DNA, 13 bp, C. elegans
ttctcaaaatatt

SEQ ID NO: 735921 - DNA, 13 bp, C. elegans
ttctcaaaatcaa

SEQ ID NO: 735922 - DNA, 14 bp, C. elegans
ttctcaaaatcttc

SEQ ID NO: 735923 - DNA, 14 bp, C. elegans
ttctcaaaatgttt

SEQ ID NO: 735924 - DNA, 13 bp, C. elegans
ttctcaaaattaa

SEQ ID NO: 735925 - DNA, 13 bp, C. elegans
ttctcaaaatttc

SEQ ID NO: 735926 - DNA, 13 bp, C. elegans
ttctcaaaatttt

SEQ ID NO: 735927 - DNA, 13 bp, C. elegans
ttctcaaacaatt

SEQ ID NO: 735928 - DNA, 13 bp, C. elegans
ttctcaaacttct

SEQ ID NO: 735929 - DNA, 13 bp, C. elegans
ttctcaaactttc

SEQ ID NO: 735930 - DNA, 13 bp, C. elegans
ttctcaaagtttc

SEQ ID NO: 735931 - DNA, 13 bp, C. elegans
ttctcaaataatt

SEQ ID NO: 735932 - DNA, 13 bp, C. elegans
ttctcaaatcaaa

SEQ ID NO: 735933 - DNA, 13 bp, C. elegans
ttctcaaatcatt

SEQ ID NO: 735934 - DNA, 13 bp, C. elegans
ttctcaaattaat

SEQ ID NO: 735935 - DNA, 13 bp, C. elegans
ttctcaaattatt

SEQ ID NO: 735936 - DNA, 13 bp, C. elegans
ttctcaaattctc

SEQ ID NO: 735937 - DNA, 13 bp, C. elegans
ttctcaaattctt

SEQ ID NO: 735938 - DNA, 13 bp, C. elegans
ttctcaaattgtt

SEQ ID NO: 735939 - DNA, 13 bp, C. elegans
ttctcaaatttca

SEQ ID NO: 735940 - DNA, 13 bp, C. elegans
ttctcaaatttga

SEQ ID NO: 735941 - DNA, 13 bp, C. elegans
ttctcaaatttta

SEQ ID NO: 735942 - DNA, 13 bp, C. elegans
ttctcaacaaaat

SEQ ID NO: 735943 - DNA, 13 bp, C. elegans
ttctcaacaatat

SEQ ID NO: 735944 - DNA, 13 bp, C. elegans
ttctcaacaattt

SEQ ID NO: 735945 - DNA, 13 bp, C. elegans
ttctcaacagatt

SEQ ID NO: 735946 - DNA, 13 bp, C. elegans
ttctcaacagttt

SEQ ID NO: 735947 - DNA, 13 bp, C. elegans
ttctcaactaatt

SEQ ID NO: 735948 - DNA, 13 bp, C. elegans
ttctcaactttca

SEQ ID NO: 735949 - DNA, 13 bp, C. elegans
ttctcaacttttc

SEQ ID NO: 735950 - DNA, 13 bp, C. elegans
ttctcaagaaatt

SEQ ID NO: 735951 - DNA, 13 bp, C. elegans
ttctcaagaattc

SEQ ID NO: 735952 - DNA, 13 bp, C. elegans
ttctcaagaattt

SEQ ID NO: 735953 - DNA, 13 bp, C. elegans
ttctcaagatttt

SEQ ID NO: 735954 - DNA, 13 bp, C. elegans
ttctcaagtttta

SEQ ID NO: 735955 - DNA, 13 bp, C. elegans
ttctcaagttttt

SEQ ID NO: 735956 - DNA, 13 bp, C. elegans
ttctcaataaaat

SEQ ID NO: 735957 - DNA, 13 bp, C. elegans
ttctcaataaaca

SEQ ID NO: 735958 - DNA, 13 bp, C. elegans
ttctcaataaatt

SEQ ID NO: 735959 - DNA, 13 bp, C. elegans
ttctcaataattc

SEQ ID NO: 735960 - DNA, 13 bp, C. elegans
ttctcaatgaggc

SEQ ID NO: 735961 - DNA, 13 bp, C. elegans
ttctcaatggagc

SEQ ID NO: 735962 - DNA, 13 bp, C. elegans
ttctcaatgtttc

SEQ ID NO: 735963 - DNA, 13 bp, C. elegans
ttctcaatgtttt

SEQ ID NO: 735964 - DNA, 14 bp, C. elegans
ttctcaatgttttt

SEQ ID NO: 735965 - DNA, 13 bp, C. elegans
ttctcaattaatt

SEQ ID NO: 735966 - DNA, 13 bp, C. elegans
ttctcaattataa

SEQ ID NO: 735967 - DNA, 13 bp, C. elegans
ttctcaatttcca

SEQ ID NO: 735968 - DNA, 13 bp, C. elegans
ttctcaatttctc

SEQ ID NO: 735969 - DNA, 13 bp, C. elegans
ttctcaattttag

SEQ ID NO: 735970 - DNA, 13 bp, C. elegans
ttctcaattttca

SEQ ID NO: 735971 - DNA, 13 bp, C. elegans
ttctcaattttga

SEQ ID NO: 735972 - DNA, 13 bp, C. elegans
ttctcacaaaaat

SEQ ID NO: 735973 - DNA, 13 bp, C. elegans
ttctcacaacttt

SEQ ID NO: 735974 - DNA, 13 bp, C. elegans
ttctcacaatcag

SEQ ID NO: 735975 - DNA, 13 bp, C. elegans
ttctcacaatttg

SEQ ID NO: 735976 - DNA, 13 bp, C. elegans
ttctcacaatttt

SEQ ID NO: 735977 - DNA, 13 bp, C. elegans
ttctcacacacac

SEQ ID NO: 735978 - DNA, 13 bp, C. elegans
ttctcacactttt

SEQ ID NO: 735979 - DNA, 13 bp, C. elegans
ttctcacatttct

SEQ ID NO: 735980 - DNA, 13 bp, C. elegans
ttctcacattttc

SEQ ID NO: 735981 - DNA, 13 bp, C. elegans
ttctcaccaaaaa

SEQ ID NO: 735982 - DNA, 13 bp, C. elegans
ttctcacgtgaat

SEQ ID NO: 735983 - DNA, 13 bp, C. elegans
ttctcactcattt

SEQ ID NO: 735984 - DNA, 13 bp, C. elegans
ttctcactgaaaa

SEQ ID NO: 735985 - DNA, 13 bp, C. elegans
ttctcacttcaaa

SEQ ID NO: 735986 - DNA, 13 bp, C. elegans
ttctcactttcaa

SEQ ID NO: 735987 - DNA, 13 bp, C. elegans
ttctcactttcca

SEQ ID NO: 735988 - DNA, 13 bp, C. elegans
ttctcacttttca

SEQ ID NO: 735989 - DNA, 13 bp, C. elegans
ttctcactttttg

SEQ ID NO: 735990 - DNA, 13 bp, C. elegans
ttctcagaaaaaa

SEQ ID NO: 735991 - DNA, 13 bp, C. elegans
ttctcagaaaaat

SEQ ID NO: 735992 - DNA, 13 bp, C. elegans
ttctcagaaaact

SEQ ID NO: 735993 - DNA, 13 bp, C. elegans
ttctcagaaaatc

SEQ ID NO: 735994 - DNA, 13 bp, C. elegans
ttctcagaaaatg

SEQ ID NO: 735995 - DNA, 13 bp, C. elegans
ttctcagaaataa

SEQ ID NO: 735996 - DNA, 13 bp, C. elegans
ttctcagaaatgt

SEQ ID NO: 735997 - DNA, 13 bp, C. elegans
ttctcagaaattt

SEQ ID NO: 735998 - DNA, 13 bp, C. elegans
ttctcagaacttt

SEQ ID NO: 735999 - DNA, 13 bp, C. elegans
ttctcagaatttg

SEQ ID NO: 736000 - DNA, 13 bp, C. elegans
ttctcagaatttt

SEQ ID NO: 736001 - DNA, 13 bp, C. elegans
ttctcagatattt

SEQ ID NO: 736002 - DNA, 13 bp, C. elegans
ttctcagatgttt

SEQ ID NO: 736003 - DNA, 13 bp, C. elegans
ttctcagatttta

SEQ ID NO: 736004 - DNA, 13 bp, C. elegans
ttctcagcttcaa

SEQ ID NO: 736005 - DNA, 13 bp, C. elegans
ttctcagcttttt

SEQ ID NO: 736006 - DNA, 13 bp, C. elegans
ttctcagtttaaa

SEQ ID NO: 736007 - DNA, 13 bp, C. elegans
ttctcataaatca

SEQ ID NO: 736008 - DNA, 13 bp, C. elegans
ttctcataataaa

SEQ ID NO: 736009 - DNA, 13 bp, C. elegans
ttctcataatatt

SEQ ID NO: 736010 - DNA, 13 bp, C. elegans
ttctcataattat

SEQ ID NO: 736011 - DNA, 13 bp, C. elegans
ttctcatagaatt

SEQ ID NO: 736012 - DNA, 13 bp, C. elegans
ttctcatatttca

SEQ ID NO: 736013 - DNA, 13 bp, C. elegans
ttctcatcaaatc

SEQ ID NO: 736014 - DNA, 13 bp, C. elegans
ttctcatcaattt

SEQ ID NO: 736015 - DNA, 13 bp, C. elegans
ttctcatcatgaa

SEQ ID NO: 736016 - DNA, 13 bp, C. elegans
ttctcatcgattt

SEQ ID NO: 736017 - DNA, 13 bp, C. elegans
ttctcatctccag

SEQ ID NO: 736018 - DNA, 13 bp, C. elegans
ttctcatgaaaat

SEQ ID NO: 736019 - DNA, 13 bp, C. elegans
ttctcatgatttt

SEQ ID NO: 736020 - DNA, 13 bp, C. elegans
ttctcatgtttcc

SEQ ID NO: 736021 - DNA, 13 bp, C. elegans
ttctcatgttttc

SEQ ID NO: 736022 - DNA, 13 bp, C. elegans
ttctcattatcag

SEQ ID NO: 736023 - DNA, 13 bp, C. elegans
ttctcattcttca

SEQ ID NO: 736024 - DNA, 13 bp, C. elegans
ttctcattgaaaa

SEQ ID NO: 736025 - DNA, 13 bp, C. elegans
ttctcattgacta

SEQ ID NO: 736026 - DNA, 13 bp, C. elegans
ttctcattggagc

SEQ ID NO: 736027 - DNA, 13 bp, C. elegans
ttctcatttcaat

SEQ ID NO: 736028 - DNA, 13 bp, C. elegans
ttctcatttcaca

SEQ ID NO: 736029 - DNA, 13 bp, C. elegans
ttctcatttccaa

SEQ ID NO: 736030 - DNA, 13 bp, C. elegans
ttctcatttccca

SEQ ID NO: 736031 - DNA, 13 bp, C. elegans
ttctcatttccta

SEQ ID NO: 736032 - DNA, 13 bp, C. elegans
ttctcatttctaa

SEQ ID NO: 736033 - DNA, 13 bp, C. elegans
ttctcattttcaa

SEQ ID NO: 736034 - DNA, 13 bp, C. elegans
ttctcattttcca

SEQ ID NO: 736035 - DNA, 13 bp, C. elegans
ttctcattttcga

SEQ ID NO: 736036 - DNA, 13 bp, C. elegans
ttctcattttgca

SEQ ID NO: 736037 - DNA, 13 bp, C. elegans
ttctcattttgtc

SEQ ID NO: 736038 - DNA, 13 bp, C. elegans
ttctcatttttga

SEQ ID NO: 736039 - DNA, 13 bp, C. elegans
ttctccaaaaaaa

SEQ ID NO: 736040 - DNA, 13 bp, C. elegans
ttctccaaaaaac

SEQ ID NO: 736041 - DNA, 13 bp, C. elegans
ttctccaaaaaag

SEQ ID NO: 736042 - DNA, 13 bp, C. elegans
ttctccaaaaatt

SEQ ID NO: 736043 - DNA, 13 bp, C. elegans
ttctccaaaacaa

SEQ ID NO: 736044 - DNA, 13 bp, C. elegans
ttctccaaaataa

SEQ ID NO: 736045 - DNA, 13 bp, C. elegans
ttctccaaaattc

SEQ ID NO: 736046 - DNA, 13 bp, C. elegans
ttctccaaataaa

SEQ ID NO: 736047 - DNA, 13 bp, C. elegans
ttctccaaatctc

SEQ ID NO: 736048 - DNA, 13 bp, C. elegans
ttctccaaatgaa

SEQ ID NO: 736049 - DNA, 13 bp, C. elegans
ttctccaaatttt

SEQ ID NO: 736050 - DNA, 13 bp, C. elegans
ttctccaactttc

SEQ ID NO: 736051 - DNA, 13 bp, C. elegans
ttctccaagaaaa

SEQ ID NO: 736052 - DNA, 13 bp, C. elegans
ttctccaataaaa

SEQ ID NO: 736053 - DNA, 13 bp, C. elegans
ttctccaattcca

SEQ ID NO: 736054 - DNA, 13 bp, C. elegans
ttctccaattgtt

SEQ ID NO: 736055 - DNA, 13 bp, C. elegans
ttctccaatttcc

SEQ ID NO: 736056 - DNA, 13 bp, C. elegans
ttctccaattttc

SEQ ID NO: 736057 - DNA, 13 bp, C. elegans
ttctccacaaaaa

SEQ ID NO: 736058 - DNA, 13 bp, C. elegans
ttctccacaaaat

SEQ ID NO: 736059 - DNA, 13 bp, C. elegans
ttctccacatttt

SEQ ID NO: 736060 - DNA, 13 bp, C. elegans
ttctccagaaaaa

SEQ ID NO: 736061 - DNA, 13 bp, C. elegans
ttctccagttttt

SEQ ID NO: 736062 - DNA, 13 bp, C. elegans
ttctccataaatc

SEQ ID NO: 736063 - DNA, 13 bp, C. elegans
ttctccataattt

SEQ ID NO: 736064 - DNA, 13 bp, C. elegans
ttctccatatatg

SEQ ID NO: 736065 - DNA, 13 bp, C. elegans
ttctccatcttgc

SEQ ID NO: 736066 - DNA, 13 bp, C. elegans
ttctccatttttg

SEQ ID NO: 736067 - DNA, 13 bp, C. elegans
ttctcccaaaatt

SEQ ID NO: 736068 - DNA, 13 bp, C. elegans
ttctcccaatttc

SEQ ID NO: 736069 - DNA, 13 bp, C. elegans
ttctcccaatttt

SEQ ID NO: 736070 - DNA, 13 bp, C. elegans
ttctcccacattt

SEQ ID NO: 736071 - DNA, 13 bp, C. elegans
ttctccgaaaaat

SEQ ID NO: 736072 - DNA, 13 bp, C. elegans
ttctccgaaaatt

SEQ ID NO: 736073 - DNA, 13 bp, C. elegans
ttctccgaatttt

SEQ ID NO: 736074 - DNA, 13 bp, C. elegans
ttctccgtcattt

SEQ ID NO: 736075 - DNA, 13 bp, C. elegans
ttctccgttttca

SEQ ID NO: 736076 - DNA, 13 bp, C. elegans
ttctcctaaaaat

SEQ ID NO: 736077 - DNA, 13 bp, C. elegans
ttctcctcaattt

SEQ ID NO: 736078 - DNA, 13 bp, C. elegans
ttctcctttcaat

SEQ ID NO: 736079 - DNA, 13 bp, C. elegans
ttctcgaaaaaaa

SEQ ID NO: 736080 - DNA, 13 bp, C. elegans
ttctcgaaaaatc

SEQ ID NO: 736081 - DNA, 14 bp, C. elegans
ttctcgaaaaatca

SEQ ID NO: 736082 - DNA, 13 bp, C. elegans
ttctcgaaaaatt

SEQ ID NO: 736083 - DNA, 13 bp, C. elegans
ttctcgaaaacta

SEQ ID NO: 736084 - DNA, 13 bp, C. elegans
ttctcgaaaatct

SEQ ID NO: 736085 - DNA, 13 bp, C. elegans
ttctcgaaaatgt

SEQ ID NO: 736086 - DNA, 13 bp, C. elegans
ttctcgaaaattc

SEQ ID NO: 736087 - DNA, 13 bp, C. elegans
ttctcgaaaattt

SEQ ID NO: 736088 - DNA, 13 bp, C. elegans
ttctcgaaattcc

SEQ ID NO: 736089 - DNA, 13 bp, C. elegans
ttctcgaaattct

SEQ ID NO: 736090 - DNA, 13 bp, C. elegans
ttctcgaaatttc

SEQ ID NO: 736091 - DNA, 13 bp, C. elegans
ttctcgaagaaaa

SEQ ID NO: 736092 - DNA, 13 bp, C. elegans
ttctcgaataaaa

SEQ ID NO: 736093 - DNA, 13 bp, C. elegans
ttctcgaatgttc

SEQ ID NO: 736094 - DNA, 13 bp, C. elegans
ttctcgacactgt

SEQ ID NO: 736095 - DNA, 13 bp, C. elegans
ttctcgagaaaaa

SEQ ID NO: 736096 - DNA, 13 bp, C. elegans
ttctcgagttttc

SEQ ID NO: 736097 - DNA, 13 bp, C. elegans
ttctcgatatttt

SEQ ID NO: 736098 - DNA, 13 bp, C. elegans
ttctcgatgaaaa

SEQ ID NO: 736099 - DNA, 13 bp, C. elegans
ttctcgatttcaa

SEQ ID NO: 736100 - DNA, 13 bp, C. elegans
ttctcgatttctc

SEQ ID NO: 736101 - DNA, 13 bp, C. elegans
ttctcgattttca

SEQ ID NO: 736102 - DNA, 13 bp, C. elegans
ttctcgattttct

SEQ ID NO: 736103 - DNA, 13 bp, C. elegans
ttctcgattttgt

SEQ ID NO: 736104 - DNA, 13 bp, C. elegans
ttctcgatttttc

SEQ ID NO: 736105 - DNA, 13 bp, C. elegans
ttctcgcattttt

SEQ ID NO: 736106 - DNA, 13 bp, C. elegans
ttctcgccaaaat

SEQ ID NO: 736107 - DNA, 13 bp, C. elegans
ttctcgccaattt

SEQ ID NO: 736108 - DNA, 13 bp, C. elegans
ttctcgccatagt

SEQ ID NO: 736109 - DNA, 13 bp, C. elegans
ttctcggaaaatc

SEQ ID NO: 736110 - DNA, 13 bp, C. elegans
ttctcggaaaatt

SEQ ID NO: 736111 - DNA, 14 bp, C. elegans
ttctcggagatcaa

SEQ ID NO: 736112 - DNA, 13 bp, C. elegans
ttctcggattttc

SEQ ID NO: 736113 - DNA, 13 bp, C. elegans
ttctcggtgttgc

SEQ ID NO: 736114 - DNA, 13 bp, C. elegans
ttctcgtcaaaaa

SEQ ID NO: 736115 - DNA, 13 bp, C. elegans
ttctcgtcaattt

SEQ ID NO: 736116 - DNA, 13 bp, C. elegans
ttctcgtcatttt

SEQ ID NO: 736117 - DNA, 13 bp, C. elegans
ttctcgttatttc

SEQ ID NO: 736118 - DNA, 13 bp, C. elegans
ttctcgttcaaaa

SEQ ID NO: 736119 - DNA, 13 bp, C. elegans
ttctctaaaactt

SEQ ID NO: 736120 - DNA, 13 bp, C. elegans
ttctctaaaatat

SEQ ID NO: 736121 - DNA, 13 bp, C. elegans
ttctctaaaattc

SEQ ID NO: 736122 - DNA, 13 bp, C. elegans
ttctctaaaattt

SEQ ID NO: 736123 - DNA, 13 bp, C. elegans
ttctctaaacatt

SEQ ID NO: 736124 - DNA, 13 bp, C. elegans
ttctctaaacctc

SEQ ID NO: 736125 - DNA, 13 bp, C. elegans
ttctctaaacttt

SEQ ID NO: 736126 - DNA, 13 bp, C. elegans
ttctctaaatatt

SEQ ID NO: 736127 - DNA, 13 bp, C. elegans
ttctctaaattct

SEQ ID NO: 736128 - DNA, 13 bp, C. elegans
ttctctaacattt

SEQ ID NO: 736129 - DNA, 13 bp, C. elegans
ttctctaattctc

SEQ ID NO: 736130 - DNA, 13 bp, C. elegans
ttctctaatttca

SEQ ID NO: 736131 - DNA, 13 bp, C. elegans
ttctctaattttg

SEQ ID NO: 736132 - DNA, 13 bp, C. elegans
ttctctacaaaat

SEQ ID NO: 736133 - DNA, 13 bp, C. elegans
ttctctacaattt

SEQ ID NO: 736134 - DNA, 13 bp, C. elegans
ttctctacgtctc

SEQ ID NO: 736135 - DNA, 13 bp, C. elegans
ttctctacgtttt

SEQ ID NO: 736136 - DNA, 13 bp, C. elegans
ttctctataaaat

SEQ ID NO: 736137 - DNA, 13 bp, C. elegans
ttctctattagag

SEQ ID NO: 736138 - DNA, 13 bp, C. elegans
ttctctcaaaaaa

SEQ ID NO: 736139 - DNA, 13 bp, C. elegans
ttctctcaaaaac

SEQ ID NO: 736140 - DNA, 13 bp, C. elegans
ttctctcaatctc

SEQ ID NO: 736141 - DNA, 13 bp, C. elegans
ttctctcaatttc

SEQ ID NO: 736142 - DNA, 13 bp, C. elegans
ttctctcaatttg

SEQ ID NO: 736143 - DNA, 13 bp, C. elegans
ttctctcactcac

SEQ ID NO: 736144 - DNA, 13 bp, C. elegans
ttctctcagtttt

SEQ ID NO: 736145 - DNA, 13 bp, C. elegans
ttctctcatttca

SEQ ID NO: 736146 - DNA, 13 bp, C. elegans
ttctctccaaaat

SEQ ID NO: 736147 - DNA, 13 bp, C. elegans
ttctctccaattt

SEQ ID NO: 736148 - DNA, 13 bp, C. elegans
ttctctcgaaatt

SEQ ID NO: 736149 - DNA, 13 bp, C. elegans
ttctctgaaaaaa

SEQ ID NO: 736150 - DNA, 13 bp, C. elegans
ttctctgaaaaat

SEQ ID NO: 736151 - DNA, 13 bp, C. elegans
ttctctgaaaagt

SEQ ID NO: 736152 - DNA, 13 bp, C. elegans
ttctctgaaaatg

SEQ ID NO: 736153 - DNA, 13 bp, C. elegans
ttctctgaaaatt

SEQ ID NO: 736154 - DNA, 13 bp, C. elegans
ttctctgaatatt

SEQ ID NO: 736155 - DNA, 13 bp, C. elegans
ttctctgaatctc

SEQ ID NO: 736156 - DNA, 13 bp, C. elegans
ttctctgaatttt

SEQ ID NO: 736157 - DNA, 13 bp, C. elegans
ttctctgattctc

SEQ ID NO: 736158 - DNA, 14 bp, C. elegans
ttctctgcgccctc

SEQ ID NO: 736159 - DNA, 13 bp, C. elegans
ttctctgcgtctc

SEQ ID NO: 736160 - DNA, 13 bp, C. elegans
ttctctgctatct

SEQ ID NO: 736161 - DNA, 13 bp, C. elegans
ttctctggaaaaa

SEQ ID NO: 736162 - DNA, 13 bp, C. elegans
ttctctggaaatt

SEQ ID NO: 736163 - DNA, 13 bp, C. elegans
ttctctgtcattt

SEQ ID NO: 736164 - DNA, 13 bp, C. elegans
ttctcttacaatt

SEQ ID NO: 736165 - DNA, 13 bp, C. elegans
ttctcttatcaat

SEQ ID NO: 736166 - DNA, 13 bp, C. elegans
ttctcttcaaaaa

SEQ ID NO: 736167 - DNA, 13 bp, C. elegans
ttctcttcaaaac

SEQ ID NO: 736168 - DNA, 13 bp, C. elegans
ttctcttcaaaat

SEQ ID NO: 736169 - DNA, 13 bp, C. elegans
ttctcttcaaatt

SEQ ID NO: 736170 - DNA, 13 bp, C. elegans
ttctcttcgaaaa

SEQ ID NO: 736171 - DNA, 13 bp, C. elegans
ttctcttgaaaaa

SEQ ID NO: 736172 - DNA, 13 bp, C. elegans
ttctcttgaaaac

SEQ ID NO: 736173 - DNA, 13 bp, C. elegans
ttctcttgaaaat

SEQ ID NO: 736174 - DNA, 13 bp, C. elegans
ttctcttgattct

SEQ ID NO: 736175 - DNA, 13 bp, C. elegans
ttctcttgcattt

SEQ ID NO: 736176 - DNA, 13 bp, C. elegans
ttctcttgtttca

SEQ ID NO: 736177 - DNA, 13 bp, C. elegans
ttctctttcaaaa

SEQ ID NO: 736178 - DNA, 13 bp, C. elegans
ttctctttgacta

SEQ ID NO: 736179 - DNA, 13 bp, C. elegans
ttctcttttcaaa

SEQ ID NO: 736180 - DNA, 14 bp, C. elegans
ttctgaaaaaaata

SEQ ID NO: 736181 - DNA, 13 bp, C. elegans
ttctgaaaaaatc

SEQ ID NO: 736182 - DNA, 13 bp, C. elegans
ttctgaaaaaatt

SEQ ID NO: 736183 - DNA, 13 bp, C. elegans
ttctgaaaaagat

SEQ ID NO: 736184 - DNA, 13 bp, C. elegans
ttctgaaaaagga

SEQ ID NO: 736185 - DNA, 13 bp, C. elegans
ttctgaaaaatca

SEQ ID NO: 736186 - DNA, 13 bp, C. elegans
ttctgaaaaattc

SEQ ID NO: 736187 - DNA, 13 bp, C. elegans
ttctgaaaaattt

SEQ ID NO: 736188 - DNA, 13 bp, C. elegans
ttctgaaaacaaa

SEQ ID NO: 736189 - DNA, 13 bp, C. elegans
ttctgaaaacaat

SEQ ID NO: 736190 - DNA, 13 bp, C. elegans
ttctgaaaacatt

SEQ ID NO: 736191 - DNA, 13 bp, C. elegans
ttctgaaaaccaa

SEQ ID NO: 736192 - DNA, 13 bp, C. elegans
ttctgaaaactat

SEQ ID NO: 736193 - DNA, 13 bp, C. elegans
ttctgaaaactca

SEQ ID NO: 736194 - DNA, 13 bp, C. elegans
ttctgaaaacttt

SEQ ID NO: 736195 - DNA, 13 bp, C. elegans
ttctgaaaagcat

SEQ ID NO: 736196 - DNA, 13 bp, C. elegans
ttctgaaaataac

SEQ ID NO: 736197 - DNA, 13 bp, C. elegans
ttctgaaaataat

SEQ ID NO: 736198 - DNA, 13 bp, C. elegans
ttctgaaaatatc

SEQ ID NO: 736199 - DNA, 13 bp, C. elegans
ttctgaaaatcgg

SEQ ID NO: 736200 - DNA, 13 bp, C. elegans
ttctgaaaatcta

SEQ ID NO: 736201 - DNA, 13 bp, C. elegans
ttctgaaaatctc

SEQ ID NO: 736202 - DNA, 13 bp, C. elegans
ttctgaaaatgat

SEQ ID NO: 736203 - DNA, 13 bp, C. elegans
ttctgaaaattca

SEQ ID NO: 736204 - DNA, 13 bp, C. elegans
ttctgaaaattcc

SEQ ID NO: 736205 - DNA, 13 bp, C. elegans
ttctgaaaattct

SEQ ID NO: 736206 - DNA, 13 bp, C. elegans
ttctgaaaatttt

SEQ ID NO: 736207 - DNA, 13 bp, C. elegans
ttctgaaacaaaa

SEQ ID NO: 736208 - DNA, 13 bp, C. elegans
ttctgaaacaact

SEQ ID NO: 736209 - DNA, 13 bp, C. elegans
ttctgaaacaatt

SEQ ID NO: 736210 - DNA, 13 bp, C. elegans
ttctgaaacatat

SEQ ID NO: 736211 - DNA, 13 bp, C. elegans
ttctgaaacattc

SEQ ID NO: 736212 - DNA, 13 bp, C. elegans
ttctgaaacattt

SEQ ID NO: 736213 - DNA, 13 bp, C. elegans
ttctgaaaccaaa

SEQ ID NO: 736214 - DNA, 13 bp, C. elegans
ttctgaaactaat

SEQ ID NO: 736215 - DNA, 13 bp, C. elegans
ttctgaaactcaa

SEQ ID NO: 736216 - DNA, 13 bp, C. elegans
ttctgaaacttca

SEQ ID NO: 736217 - DNA, 13 bp, C. elegans
ttctgaaacttct

SEQ ID NO: 736218 - DNA, 13 bp, C. elegans
ttctgaaagaact

SEQ ID NO: 736219 - DNA, 13 bp, C. elegans
ttctgaaataaaa

SEQ ID NO: 736220 - DNA, 13 bp, C. elegans
ttctgaaatatgt

SEQ ID NO: 736221 - DNA, 13 bp, C. elegans
ttctgaaatcttc

SEQ ID NO: 736222 - DNA, 13 bp, C. elegans
ttctgaaatgctc

SEQ ID NO: 736223 - DNA, 13 bp, C. elegans
ttctgaaatgttg

SEQ ID NO: 736224 - DNA, 13 bp, C. elegans
ttctgaaattatt

SEQ ID NO: 736225 - DNA, 13 bp, C. elegans
ttctgaaattcaa

SEQ ID NO: 736226 - DNA, 13 bp, C. elegans
ttctgaaattcac

SEQ ID NO: 736227 - DNA, 13 bp, C. elegans
ttctgaaattctt

SEQ ID NO: 736228 - DNA, 13 bp, C. elegans
ttctgaaattgca

SEQ ID NO: 736229 - DNA, 13 bp, C. elegans
ttctgaaatttga

SEQ ID NO: 736230 - DNA, 13 bp, C. elegans
ttctgaaatttta

SEQ ID NO: 736231 - DNA, 13 bp, C. elegans
ttctgaacaaaaa

SEQ ID NO: 736232 - DNA, 13 bp, C. elegans
ttctgaacaaaat

SEQ ID NO: 736233 - DNA, 13 bp, C. elegans
ttctgaacaacaa

SEQ ID NO: 736234 - DNA, 13 bp, C. elegans
ttctgaacaagtt

SEQ ID NO: 736235 - DNA, 13 bp, C. elegans
ttctgaacaattt

SEQ ID NO: 736236 - DNA, 13 bp, C. elegans
ttctgaacacttt

SEQ ID NO: 736237 - DNA, 13 bp, C. elegans
ttctgaacatatt

SEQ ID NO: 736238 - DNA, 13 bp, C. elegans
ttctgaacatttt

SEQ ID NO: 736239 - DNA, 13 bp, C. elegans
ttctgaactattt

SEQ ID NO: 736240 - DNA, 13 bp, C. elegans
ttctgaactgatt

SEQ ID NO: 736241 - DNA, 13 bp, C. elegans
ttctgaacttttc

SEQ ID NO: 736242 - DNA, 13 bp, C. elegans
ttctgaagagaaa

SEQ ID NO: 736243 - DNA, 13 bp, C. elegans
ttctgaaggtttt

SEQ ID NO: 736244 - DNA, 13 bp, C. elegans
ttctgaagtaaaa

SEQ ID NO: 736245 - DNA, 13 bp, C. elegans
ttctgaagttatt

SEQ ID NO: 736246 - DNA, 13 bp, C. elegans
ttctgaagtttcc

SEQ ID NO: 736247 - DNA, 13 bp, C. elegans
ttctgaagtttta

SEQ ID NO: 736248 - DNA, 13 bp, C. elegans
ttctgaagttttt

SEQ ID NO: 736249 - DNA, 13 bp, C. elegans
ttctgaataaaac

SEQ ID NO: 736250 - DNA, 13 bp, C. elegans
ttctgaataagaa

SEQ ID NO: 736251 - DNA, 13 bp, C. elegans
ttctgaataatat

SEQ ID NO: 736252 - DNA, 13 bp, C. elegans
ttctgaatataaa

SEQ ID NO: 736253 - DNA, 13 bp, C. elegans
ttctgaatatatt

SEQ ID NO: 736254 - DNA, 13 bp, C. elegans
ttctgaatatctt

SEQ ID NO: 736255 - DNA, 13 bp, C. elegans
ttctgaatattat

SEQ ID NO: 736256 - DNA, 13 bp, C. elegans
ttctgaatattct

SEQ ID NO: 736257 - DNA, 13 bp, C. elegans
ttctgaatatttc

SEQ ID NO: 736258 - DNA, 13 bp, C. elegans
ttctgaatatttt

SEQ ID NO: 736259 - DNA, 13 bp, C. elegans
ttctgaatctgaa

SEQ ID NO: 736260 - DNA, 13 bp, C. elegans
ttctgaatgtttt

SEQ ID NO: 736261 - DNA, 13 bp, C. elegans
ttctgaattagtt

SEQ ID NO: 736262 - DNA, 13 bp, C. elegans
ttctgaattctga

SEQ ID NO: 736263 - DNA, 13 bp, C. elegans
ttctgaattctgt

SEQ ID NO: 736264 - DNA, 13 bp, C. elegans
ttctgaattcttt

SEQ ID NO: 736265 - DNA, 13 bp, C. elegans
ttctgaattggat

SEQ ID NO: 736266 - DNA, 13 bp, C. elegans
ttctgaatttaat

SEQ ID NO: 736267 - DNA, 13 bp, C. elegans
ttctgaatttctg

SEQ ID NO: 736268 - DNA, 13 bp, C. elegans
ttctgaatttgtt

SEQ ID NO: 736269 - DNA, 13 bp, C. elegans
ttctgaattttaa

SEQ ID NO: 736270 - DNA, 13 bp, C. elegans
ttctgaattttac

SEQ ID NO: 736271 - DNA, 13 bp, C. elegans
ttctgaattttat

SEQ ID NO: 736272 - DNA, 13 bp, C. elegans
ttctgaattttcc

SEQ ID NO: 736273 - DNA, 13 bp, C. elegans
ttctgaattttgg

SEQ ID NO: 736274 - DNA, 13 bp, C. elegans
ttctgaattttta

SEQ ID NO: 736275 - DNA, 13 bp, C. elegans
ttctgaatttttg

SEQ ID NO: 736276 - DNA, 13 bp, C. elegans
ttctgacaaattg

SEQ ID NO: 736277 - DNA, 13 bp, C. elegans
ttctgaccatttt

SEQ ID NO: 736278 - DNA, 13 bp, C. elegans
ttctgagaaaaaa

SEQ ID NO: 736279 - DNA, 13 bp, C. elegans
ttctgagaaaaag

SEQ ID NO: 736280 - DNA, 13 bp, C. elegans
ttctgagaaaata

SEQ ID NO: 736281 - DNA, 13 bp, C. elegans
ttctgagaaatca

SEQ ID NO: 736282 - DNA, 13 bp, C. elegans
ttctgagaacaat

SEQ ID NO: 736283 - DNA, 13 bp, C. elegans
ttctgagaagaaa

SEQ ID NO: 736284 - DNA, 13 bp, C. elegans
ttctgagaatatt

SEQ ID NO: 736285 - DNA, 13 bp, C. elegans
ttctgagagtttt

SEQ ID NO: 736286 - DNA, 13 bp, C. elegans
ttctgagcaaaat

SEQ ID NO: 736287 - DNA, 13 bp, C. elegans
ttctgagcattgt

SEQ ID NO: 736288 - DNA, 13 bp, C. elegans
ttctgagcatttt

SEQ ID NO: 736289 - DNA, 13 bp, C. elegans
ttctgagccaaaa

SEQ ID NO: 736290 - DNA, 13 bp, C. elegans
ttctgataaaatc

SEQ ID NO: 736291 - DNA, 13 bp, C. elegans
ttctgataaattt

SEQ ID NO: 736292 - DNA, 13 bp, C. elegans
ttctgataataaa

SEQ ID NO: 736293 - DNA, 13 bp, C. elegans
ttctgataatttt

SEQ ID NO: 736294 - DNA, 13 bp, C. elegans
ttctgatagtgag

SEQ ID NO: 736295 - DNA, 13 bp, C. elegans
ttctgatattaaa

SEQ ID NO: 736296 - DNA, 13 bp, C. elegans
ttctgatatttcc

SEQ ID NO: 736297 - DNA, 13 bp, C. elegans
ttctgatcaattt

SEQ ID NO: 736298 - DNA, 13 bp, C. elegans
ttctgatccttca

SEQ ID NO: 736299 - DNA, 13 bp, C. elegans
ttctgatgaagta

SEQ ID NO: 736300 - DNA, 13 bp, C. elegans
ttctgatgatttc

SEQ ID NO: 736301 - DNA, 13 bp, C. elegans
ttctgatggaaaa

SEQ ID NO: 736302 - DNA, 13 bp, C. elegans
ttctgatggtttt

SEQ ID NO: 736303 - DNA, 13 bp, C. elegans
ttctgatgttttc

SEQ ID NO: 736304 - DNA, 13 bp, C. elegans
ttctgattaaaaa

SEQ ID NO: 736305 - DNA, 13 bp, C. elegans
ttctgattcaaaa

SEQ ID NO: 736306 - DNA, 14 bp, C. elegans
ttctgattctccat

SEQ ID NO: 736307 - DNA, 13 bp, C. elegans
ttctgattctctt

SEQ ID NO: 736308 - DNA, 13 bp, C. elegans
ttctgattctgaa

SEQ ID NO: 736309 - DNA, 14 bp, C. elegans
ttctgattcttccg

SEQ ID NO: 736310 - DNA, 13 bp, C. elegans
ttctgattgaaat

SEQ ID NO: 736311 - DNA, 13 bp, C. elegans
ttctgatttaaaa

SEQ ID NO: 736312 - DNA, 13 bp, C. elegans
ttctgatttataa

SEQ ID NO: 736313 - DNA, 13 bp, C. elegans
ttctgatttcaat

SEQ ID NO: 736314 - DNA, 13 bp, C. elegans
ttctgatttgaaa

SEQ ID NO: 736315 - DNA, 13 bp, C. elegans
ttctgattttaat

SEQ ID NO: 736316 - DNA, 13 bp, C. elegans
ttctgattttgag

SEQ ID NO: 736317 - DNA, 13 bp, C. elegans
ttctgattttgat

SEQ ID NO: 736318 - DNA, 13 bp, C. elegans
ttctgatttttag

SEQ ID NO: 736319 - DNA, 13 bp, C. elegans
ttctgatttttca

SEQ ID NO: 736320 - DNA, 13 bp, C. elegans
ttctgcaaaaaat

SEQ ID NO: 736321 - DNA, 13 bp, C. elegans
ttctgcaaaaact

SEQ ID NO: 736322 - DNA, 13 bp, C. elegans
ttctgcaaaaatt

SEQ ID NO: 736323 - DNA, 13 bp, C. elegans
ttctgcaaaactt

SEQ ID NO: 736324 - DNA, 13 bp, C. elegans
ttctgcaaaataa

SEQ ID NO: 736325 - DNA, 13 bp, C. elegans
ttctgcaaaatgt

SEQ ID NO: 736326 - DNA, 13 bp, C. elegans
ttctgcaaaattg

SEQ ID NO: 736327 - DNA, 13 bp, C. elegans
ttctgcaaattgt

SEQ ID NO: 736328 - DNA, 14 bp, C. elegans
ttctgcaactgccg

SEQ ID NO: 736329 - DNA, 13 bp, C. elegans
ttctgcaactttc

SEQ ID NO: 736330 - DNA, 13 bp, C. elegans
ttctgcaagtttt

SEQ ID NO: 736331 - DNA, 13 bp, C. elegans
ttctgcaatattt

SEQ ID NO: 736332 - DNA, 13 bp, C. elegans
ttctgcaatgttt

SEQ ID NO: 736333 - DNA, 13 bp, C. elegans
ttctgcaattgcc

SEQ ID NO: 736334 - DNA, 13 bp, C. elegans
ttctgcaattttg

SEQ ID NO: 736335 - DNA, 13 bp, C. elegans
ttctgcacatttt

SEQ ID NO: 736336 - DNA, 13 bp, C. elegans
ttctgcatttttg

SEQ ID NO: 736337 - DNA, 13 bp, C. elegans
ttctgccaaaaaa

SEQ ID NO: 736338 - DNA, 14 bp, C. elegans
ttctgccaacaatt

SEQ ID NO: 736339 - DNA, 13 bp, C. elegans
ttctgccaacttt

SEQ ID NO: 736340 - DNA, 13 bp, C. elegans
ttctgccaatttt

SEQ ID NO: 736341 - DNA, 13 bp, C. elegans
ttctgccagaaaa

SEQ ID NO: 736342 - DNA, 13 bp, C. elegans
ttctgccattcac

SEQ ID NO: 736343 - DNA, 13 bp, C. elegans
ttctgccgatttt

SEQ ID NO: 736344 - DNA, 13 bp, C. elegans
ttctgcggaattt

SEQ ID NO: 736345 - DNA, 13 bp, C. elegans
ttctgctaaaaaa

SEQ ID NO: 736346 - DNA, 13 bp, C. elegans
ttctgctcaaatt

SEQ ID NO: 736347 - DNA, 13 bp, C. elegans
ttctgctcatttt

SEQ ID NO: 736348 - DNA, 13 bp, C. elegans
ttctgctgaaaaa

SEQ ID NO: 736349 - DNA, 13 bp, C. elegans
ttctgctgaaaag

SEQ ID NO: 736350 - DNA, 13 bp, C. elegans
ttctgctgctgct

SEQ ID NO: 736351 - DNA, 13 bp, C. elegans
ttctgcttttgag

SEQ ID NO: 736352 - DNA, 13 bp, C. elegans
ttctggaaaaaag

SEQ ID NO: 736353 - DNA, 13 bp, C. elegans
ttctggaaaaatc

SEQ ID NO: 736354 - DNA, 13 bp, C. elegans
ttctggaaaagtt

SEQ ID NO: 736355 - DNA, 13 bp, C. elegans
ttctggaaaataa

SEQ ID NO: 736356 - DNA, 13 bp, C. elegans
ttctggaaaatcg

SEQ ID NO: 736357 - DNA, 14 bp, C. elegans
ttctggaaaattca

SEQ ID NO: 736358 - DNA, 13 bp, C. elegans
ttctggaaacttc

SEQ ID NO: 736359 - DNA, 13 bp, C. elegans
ttctggaaagttc

SEQ ID NO: 736360 - DNA, 13 bp, C. elegans
ttctggaaagttt

SEQ ID NO: 736361 - DNA, 13 bp, C. elegans
ttctggaaatcaa

SEQ ID NO: 736362 - DNA, 13 bp, C. elegans
ttctggaaatcta

SEQ ID NO: 736363 - DNA, 13 bp, C. elegans
ttctggaaatgtt

SEQ ID NO: 736364 - DNA, 13 bp, C. elegans
ttctggaaatttc

SEQ ID NO: 736365 - DNA, 13 bp, C. elegans
ttctggaacattt

SEQ ID NO: 736366 - DNA, 13 bp, C. elegans
ttctggaagaaat

SEQ ID NO: 736367 - DNA, 13 bp, C. elegans
ttctggaagcttt

SEQ ID NO: 736368 - DNA, 13 bp, C. elegans
ttctggaagtttg

SEQ ID NO: 736369 - DNA, 13 bp, C. elegans
ttctggaagtttt

SEQ ID NO: 736370 - DNA, 13 bp, C. elegans
ttctggaataaat

SEQ ID NO: 736371 - DNA, 13 bp, C. elegans
ttctggaatattc

SEQ ID NO: 736372 - DNA, 13 bp, C. elegans
ttctggaatcaat

SEQ ID NO: 736373 - DNA, 13 bp, C. elegans
ttctggaatggtt

SEQ ID NO: 736374 - DNA, 13 bp, C. elegans
ttctggaattgtt

SEQ ID NO: 736375 - DNA, 13 bp, C. elegans
ttctggaatttat

SEQ ID NO: 736376 - DNA, 13 bp, C. elegans
ttctggaatttta

SEQ ID NO: 736377 - DNA, 13 bp, C. elegans
ttctggacaattt

SEQ ID NO: 736378 - DNA, 13 bp, C. elegans
ttctggacttttt

SEQ ID NO: 736379 - DNA, 13 bp, C. elegans
ttctggagcaaaa

SEQ ID NO: 736380 - DNA, 13 bp, C. elegans
ttctggagcacaa

SEQ ID NO: 736381 - DNA, 13 bp, C. elegans
ttctggagctaca

SEQ ID NO: 736382 - DNA, 14 bp, C. elegans
ttctggagggatag

SEQ ID NO: 736383 - DNA, 13 bp, C. elegans
ttctggatgaaaa

SEQ ID NO: 736384 - DNA, 13 bp, C. elegans
ttctggattttgt

SEQ ID NO: 736385 - DNA, 13 bp, C. elegans
ttctggattttta

SEQ ID NO: 736386 - DNA, 13 bp, C. elegans
ttctggatttttc

SEQ ID NO: 736387 - DNA, 13 bp, C. elegans
ttctggcagtttt

SEQ ID NO: 736388 - DNA, 13 bp, C. elegans
ttctgggaaaatc

SEQ ID NO: 736389 - DNA, 13 bp, C. elegans
ttctgggaatttg

SEQ ID NO: 736390 - DNA, 13 bp, C. elegans
ttctgggatttct

SEQ ID NO: 736391 - DNA, 13 bp, C. elegans
ttctggtacattt

SEQ ID NO: 736392 - DNA, 13 bp, C. elegans
ttctggtcatttt

SEQ ID NO: 736393 - DNA, 13 bp, C. elegans
ttctggttaaaaa

SEQ ID NO: 736394 - DNA, 13 bp, C. elegans
ttctggtttttga

SEQ ID NO: 736395 - DNA, 13 bp, C. elegans
ttctgtaaaaaat

SEQ ID NO: 736396 - DNA, 13 bp, C. elegans
ttctgtaaaatct

SEQ ID NO: 736397 - DNA, 13 bp, C. elegans
ttctgtaaaattg

SEQ ID NO: 736398 - DNA, 13 bp, C. elegans
ttctgtaaaattt

SEQ ID NO: 736399 - DNA, 13 bp, C. elegans
ttctgtaaatata

SEQ ID NO: 736400 - DNA, 13 bp, C. elegans
ttctgtaaattct

SEQ ID NO: 736401 - DNA, 13 bp, C. elegans
ttctgtaatattt

SEQ ID NO: 736402 - DNA, 13 bp, C. elegans
ttctgtaatttaa

SEQ ID NO: 736403 - DNA, 13 bp, C. elegans
ttctgtaatttat

SEQ ID NO: 736404 - DNA, 13 bp, C. elegans
ttctgtaatttca

SEQ ID NO: 736405 - DNA, 13 bp, C. elegans
ttctgtaattttc

SEQ ID NO: 736406 - DNA, 13 bp, C. elegans
ttctgtacaaaaa

SEQ ID NO: 736407 - DNA, 14 bp, C. elegans
ttctgtacattttt

SEQ ID NO: 736408 - DNA, 13 bp, C. elegans
ttctgtacgagtt

SEQ ID NO: 736409 - DNA, 13 bp, C. elegans
ttctgtagttgga

SEQ ID NO: 736410 - DNA, 13 bp, C. elegans
ttctgtattcctt

SEQ ID NO: 736411 - DNA, 13 bp, C. elegans
ttctgtatttcta

SEQ ID NO: 736412 - DNA, 13 bp, C. elegans
ttctgtattttca

SEQ ID NO: 736413 - DNA, 13 bp, C. elegans
ttctgtattttcc

SEQ ID NO: 736414 - DNA, 13 bp, C. elegans
ttctgtcaaaaaa

SEQ ID NO: 736415 - DNA, 13 bp, C. elegans
ttctgtcaaaaac

SEQ ID NO: 736416 - DNA, 13 bp, C. elegans
ttctgtcaagaat

SEQ ID NO: 736417 - DNA, 13 bp, C. elegans
ttctgtcatcaac

SEQ ID NO: 736418 - DNA, 13 bp, C. elegans
ttctgtctaaaat

SEQ ID NO: 736419 - DNA, 13 bp, C. elegans
ttctgtctgaaat

SEQ ID NO: 736420 - DNA, 13 bp, C. elegans
ttctgtgaagttt

SEQ ID NO: 736421 - DNA, 13 bp, C. elegans
ttctgtgaatctc

SEQ ID NO: 736422 - DNA, 13 bp, C. elegans
ttctgtgaatttc

SEQ ID NO: 736423 - DNA, 13 bp, C. elegans
ttctgtgcaattt

SEQ ID NO: 736424 - DNA, 13 bp, C. elegans
ttctgtgcctaca

SEQ ID NO: 736425 - DNA, 13 bp, C. elegans
ttctgtgtgttag

SEQ ID NO: 736426 - DNA, 13 bp, C. elegans
ttctgtgttttca

SEQ ID NO: 736427 - DNA, 13 bp, C. elegans
ttctgttaaaatc

SEQ ID NO: 736428 - DNA, 13 bp, C. elegans
ttctgttaattta

SEQ ID NO: 736429 - DNA, 13 bp, C. elegans
ttctgttcaaatt

SEQ ID NO: 736430 - DNA, 13 bp, C. elegans
ttctgttcagttt

SEQ ID NO: 736431 - DNA, 13 bp, C. elegans
ttctgttcctatt

SEQ ID NO: 736432 - DNA, 13 bp, C. elegans
ttctgttgaaact

SEQ ID NO: 736433 - DNA, 13 bp, C. elegans
ttctgtttataaa

SEQ ID NO: 736434 - DNA, 13 bp, C. elegans
ttctgtttcaaat

SEQ ID NO: 736435 - DNA, 13 bp, C. elegans
ttctgtttcaaca

SEQ ID NO: 736436 - DNA, 13 bp, C. elegans
ttctgtttgaaaa

SEQ ID NO: 736437 - DNA, 13 bp, C. elegans
ttctgttttgata

SEQ ID NO: 736438 - DNA, 13 bp, C. elegans
ttctgttttggaa

SEQ ID NO: 736439 - DNA, 13 bp, C. elegans
ttctgttttgtga

SEQ ID NO: 736440 - DNA, 13 bp, C. elegans
ttcttaaaaattg

SEQ ID NO: 736441 - DNA, 13 bp, C. elegans
ttcttaaaacttc

SEQ ID NO: 736442 - DNA, 13 bp, C. elegans
ttcttaaactttg

SEQ ID NO: 736443 - DNA, 13 bp, C. elegans
ttcttaagaaaaa

SEQ ID NO: 736444 - DNA, 13 bp, C. elegans
ttcttaagaaatt

SEQ ID NO: 736445 - DNA, 13 bp, C. elegans
ttcttaatcaaaa

SEQ ID NO: 736446 - DNA, 13 bp, C. elegans
ttcttaattcaaa

SEQ ID NO: 736447 - DNA, 13 bp, C. elegans
ttcttacaaattt

SEQ ID NO: 736448 - DNA, 13 bp, C. elegans
ttcttacaattta

SEQ ID NO: 736449 - DNA, 13 bp, C. elegans
ttcttacagaaaa

SEQ ID NO: 736450 - DNA, 13 bp, C. elegans
ttcttaccaatct

SEQ ID NO: 736451 - DNA, 13 bp, C. elegans
ttcttactattag

SEQ ID NO: 736452 - DNA, 13 bp, C. elegans
ttcttagaatttt

SEQ ID NO: 736453 - DNA, 13 bp, C. elegans
ttcttatcaaaaa

SEQ ID NO: 736454 - DNA, 13 bp, C. elegans
ttcttatcaaatg

SEQ ID NO: 736455 - DNA, 13 bp, C. elegans
ttcttatcaaatt

SEQ ID NO: 736456 - DNA, 13 bp, C. elegans
ttcttatcaatat

SEQ ID NO: 736457 - DNA, 13 bp, C. elegans
ttcttatcagtta

SEQ ID NO: 736458 - DNA, 13 bp, C. elegans
ttcttatgccaaa

SEQ ID NO: 736459 - DNA, 13 bp, C. elegans
ttcttattcagaa

SEQ ID NO: 736460 - DNA, 13 bp, C. elegans
ttcttattcgaaa

SEQ ID NO: 736461 - DNA, 13 bp, C. elegans
ttcttatttccag

SEQ ID NO: 736462 - DNA, 13 bp, C. elegans
ttcttattttgaa

SEQ ID NO: 736463 - DNA, 13 bp, C. elegans
ttcttattttgga

SEQ ID NO: 736464 - DNA, 13 bp, C. elegans
ttcttcaaaaaac

SEQ ID NO: 736465 - DNA, 13 bp, C. elegans
ttcttcaaaaaca

SEQ ID NO: 736466 - DNA, 13 bp, C. elegans
ttcttcaaaaatc

SEQ ID NO: 736467 - DNA, 13 bp, C. elegans
ttcttcaaaacaa

SEQ ID NO: 736468 - DNA, 13 bp, C. elegans
ttcttcaaaacta

SEQ ID NO: 736469 - DNA, 13 bp, C. elegans
ttcttcaaaagtt

SEQ ID NO: 736470 - DNA, 13 bp, C. elegans
ttcttcaaaataa

SEQ ID NO: 736471 - DNA, 13 bp, C. elegans
ttcttcaaaattt

SEQ ID NO: 736472 - DNA, 13 bp, C. elegans
ttcttcaaacaat

SEQ ID NO: 736473 - DNA, 13 bp, C. elegans
ttcttcaaacatt

SEQ ID NO: 736474 - DNA, 13 bp, C. elegans
ttcttcaaacttt

SEQ ID NO: 736475 - DNA, 13 bp, C. elegans
ttcttcaaagaaa

SEQ ID NO: 736476 - DNA, 13 bp, C. elegans
ttcttcaaatact

SEQ ID NO: 736477 - DNA, 13 bp, C. elegans
ttcttcaaatata

SEQ ID NO: 736478 - DNA, 13 bp, C. elegans
ttcttcaaatctt

SEQ ID NO: 736479 - DNA, 13 bp, C. elegans
ttcttcaaatgct

SEQ ID NO: 736480 - DNA, 13 bp, C. elegans
ttcttcaaattct

SEQ ID NO: 736481 - DNA, 13 bp, C. elegans
ttcttcaacaaaa

SEQ ID NO: 736482 - DNA, 13 bp, C. elegans
ttcttcaacttct

SEQ ID NO: 736483 - DNA, 13 bp, C. elegans
ttcttcaactttc

SEQ ID NO: 736484 - DNA, 13 bp, C. elegans
ttcttcaagaaaa

SEQ ID NO: 736485 - DNA, 13 bp, C. elegans
ttcttcaagaaat

SEQ ID NO: 736486 - DNA, 13 bp, C. elegans
ttcttcaagtttt

SEQ ID NO: 736487 - DNA, 13 bp, C. elegans
ttcttcaattcta

SEQ ID NO: 736488 - DNA, 13 bp, C. elegans
ttcttcaattctc

SEQ ID NO: 736489 - DNA, 13 bp, C. elegans
ttcttcaattgtt

SEQ ID NO: 736490 - DNA, 13 bp, C. elegans
ttcttcaatttca

SEQ ID NO: 736491 - DNA, 13 bp, C. elegans
ttcttcaatttcc

SEQ ID NO: 736492 - DNA, 13 bp, C. elegans
ttcttcacaataa

SEQ ID NO: 736493 - DNA, 13 bp, C. elegans
ttcttcacgataa

SEQ ID NO: 736494 - DNA, 13 bp, C. elegans
ttcttcactaaaa

SEQ ID NO: 736495 - DNA, 13 bp, C. elegans
ttcttcagaaaca

SEQ ID NO: 736496 - DNA, 13 bp, C. elegans
ttcttcagaaact

SEQ ID NO: 736497 - DNA, 13 bp, C. elegans
ttcttcagcttct

SEQ ID NO: 736498 - DNA, 13 bp, C. elegans
ttcttcagctttt

SEQ ID NO: 736499 - DNA, 13 bp, C. elegans
ttcttcaggaatt

SEQ ID NO: 736500 - DNA, 13 bp, C. elegans
ttcttcagtttta

SEQ ID NO: 736501 - DNA, 13 bp, C. elegans
ttcttcataaaaa

SEQ ID NO: 736502 - DNA, 13 bp, C. elegans
ttcttcataaaat

SEQ ID NO: 736503 - DNA, 13 bp, C. elegans
ttcttcatagaaa

SEQ ID NO: 736504 - DNA, 13 bp, C. elegans
ttcttcatcaaaa

SEQ ID NO: 736505 - DNA, 13 bp, C. elegans
ttcttcatcagtc

SEQ ID NO: 736506 - DNA, 13 bp, C. elegans
ttcttcatcttca

SEQ ID NO: 736507 - DNA, 13 bp, C. elegans
ttcttcatgattt

SEQ ID NO: 736508 - DNA, 13 bp, C. elegans
ttcttcatgttct

SEQ ID NO: 736509 - DNA, 13 bp, C. elegans
ttcttcattcaaa

SEQ ID NO: 736510 - DNA, 13 bp, C. elegans
ttcttcattgaaa

SEQ ID NO: 736511 - DNA, 13 bp, C. elegans
ttcttcattgaat

SEQ ID NO: 736512 - DNA, 13 bp, C. elegans
ttcttcatttcaa

SEQ ID NO: 736513 - DNA, 13 bp, C. elegans
ttcttccaaaaaa

SEQ ID NO: 736514 - DNA, 13 bp, C. elegans
ttcttccaaaatg

SEQ ID NO: 736515 - DNA, 13 bp, C. elegans
ttcttccaaatta

SEQ ID NO: 736516 - DNA, 13 bp, C. elegans
ttcttccaatttc

SEQ ID NO: 736517 - DNA, 13 bp, C. elegans
ttcttccacaaaa

SEQ ID NO: 736518 - DNA, 13 bp, C. elegans
ttcttccacaatt

SEQ ID NO: 736519 - DNA, 13 bp, C. elegans
ttcttccgaaatt

SEQ ID NO: 736520 - DNA, 13 bp, C. elegans
ttcttcctgattt

SEQ ID NO: 736521 - DNA, 13 bp, C. elegans
ttcttcgaaaaaa

SEQ ID NO: 736522 - DNA, 14 bp, C. elegans
ttcttcgaaaaatt

SEQ ID NO: 736523 - DNA, 13 bp, C. elegans
ttcttcgaaatat

SEQ ID NO: 736524 - DNA, 13 bp, C. elegans
ttcttcgaattct

SEQ ID NO: 736525 - DNA, 13 bp, C. elegans
ttcttcgaatttc

SEQ ID NO: 736526 - DNA, 14 bp, C. elegans
ttcttcgagatgat

SEQ ID NO: 736527 - DNA, 13 bp, C. elegans
ttcttcgatttct

SEQ ID NO: 736528 - DNA, 13 bp, C. elegans
ttcttcgtcaata

SEQ ID NO: 736529 - DNA, 13 bp, C. elegans
ttcttcgtctgtc

SEQ ID NO: 736530 - DNA, 13 bp, C. elegans
ttcttctaaaaat

SEQ ID NO: 736531 - DNA, 13 bp, C. elegans
ttcttctaaatat

SEQ ID NO: 736532 - DNA, 13 bp, C. elegans
ttcttctaaattc

SEQ ID NO: 736533 - DNA, 13 bp, C. elegans
ttcttctacaaaa

SEQ ID NO: 736534 - DNA, 13 bp, C. elegans
ttcttctagaaga

SEQ ID NO: 736535 - DNA, 13 bp, C. elegans
ttcttctataaaa

SEQ ID NO: 736536 - DNA, 13 bp, C. elegans
ttcttctattcaa

SEQ ID NO: 736537 - DNA, 13 bp, C. elegans
ttcttctcaaaac

SEQ ID NO: 736538 - DNA, 13 bp, C. elegans
ttcttctcaaatt

SEQ ID NO: 736539 - DNA, 13 bp, C. elegans
ttcttctccaatt

SEQ ID NO: 736540 - DNA, 13 bp, C. elegans
ttcttctccgatt

SEQ ID NO: 736541 - DNA, 13 bp, C. elegans
ttcttctcgattt

SEQ ID NO: 736542 - DNA, 13 bp, C. elegans
ttcttctctaaaa

SEQ ID NO: 736543 - DNA, 13 bp, C. elegans
ttcttctctcaat

SEQ ID NO: 736544 - DNA, 13 bp, C. elegans
ttcttctctgaaa

SEQ ID NO: 736545 - DNA, 13 bp, C. elegans
ttcttctgaaata

SEQ ID NO: 736546 - DNA, 13 bp, C. elegans
ttcttctgaaatt

SEQ ID NO: 736547 - DNA, 13 bp, C. elegans
ttcttctgatttc

SEQ ID NO: 736548 - DNA, 13 bp, C. elegans
ttcttctgcattt

SEQ ID NO: 736549 - DNA, 13 bp, C. elegans
ttcttctggaaaa

SEQ ID NO: 736550 - DNA, 13 bp, C. elegans
ttcttctgtgaat

SEQ ID NO: 736551 - DNA, 13 bp, C. elegans
ttcttcttaaaaa

SEQ ID NO: 736552 - DNA, 13 bp, C. elegans
ttcttcttcaaat

SEQ ID NO: 736553 - DNA, 13 bp, C. elegans
ttcttcttccaaa

SEQ ID NO: 736554 - DNA, 13 bp, C. elegans
ttcttcttccatg

SEQ ID NO: 736555 - DNA, 13 bp, C. elegans
ttcttcttctaca

SEQ ID NO: 736556 - DNA, 13 bp, C. elegans
ttcttcttctcaa

SEQ ID NO: 736557 - DNA, 13 bp, C. elegans
ttcttcttctgaa

SEQ ID NO: 736558 - DNA, 13 bp, C. elegans
ttcttcttctgat

SEQ ID NO: 736559 - DNA, 13 bp, C. elegans
ttcttcttgaaat

SEQ ID NO: 736560 - DNA, 13 bp, C. elegans
ttcttcttgttca

SEQ ID NO: 736561 - DNA, 13 bp, C. elegans
ttcttctttccaa

SEQ ID NO: 736562 - DNA, 13 bp, C. elegans
ttcttcttttcag

SEQ ID NO: 736563 - DNA, 13 bp, C. elegans
ttcttgaaaaaac

SEQ ID NO: 736564 - DNA, 13 bp, C. elegans
ttcttgaaaaaat

SEQ ID NO: 736565 - DNA, 13 bp, C. elegans
ttcttgaaaaacc

SEQ ID NO: 736566 - DNA, 13 bp, C. elegans
ttcttgaaaaact

SEQ ID NO: 736567 - DNA, 13 bp, C. elegans
ttcttgaaaaaga

SEQ ID NO: 736568 - DNA, 13 bp, C. elegans
ttcttgaaaaatc

SEQ ID NO: 736569 - DNA, 13 bp, C. elegans
ttcttgaaaactg

SEQ ID NO: 736570 - DNA, 13 bp, C. elegans
ttcttgaaaactt

SEQ ID NO: 736571 - DNA, 13 bp, C. elegans
ttcttgaaaatca

SEQ ID NO: 736572 - DNA, 13 bp, C. elegans
ttcttgaaaatgt

SEQ ID NO: 736573 - DNA, 13 bp, C. elegans
ttcttgaaaattc

SEQ ID NO: 736574 - DNA, 13 bp, C. elegans
ttcttgaaacaaa

SEQ ID NO: 736575 - DNA, 13 bp, C. elegans
ttcttgaaatatt

SEQ ID NO: 736576 - DNA, 13 bp, C. elegans
ttcttgaaatctt

SEQ ID NO: 736577 - DNA, 13 bp, C. elegans
ttcttgaaattat

SEQ ID NO: 736578 - DNA, 13 bp, C. elegans
ttcttgaaatttt

SEQ ID NO: 736579 - DNA, 13 bp, C. elegans
ttcttgaacttct

SEQ ID NO: 736580 - DNA, 13 bp, C. elegans
ttcttgaagtcgg

SEQ ID NO: 736581 - DNA, 13 bp, C. elegans
ttcttgaatattc

SEQ ID NO: 736582 - DNA, 13 bp, C. elegans
ttcttgaattatt

SEQ ID NO: 736583 - DNA, 13 bp, C. elegans
ttcttgaatttct

SEQ ID NO: 736584 - DNA, 13 bp, C. elegans
ttcttgacaaatt

SEQ ID NO: 736585 - DNA, 13 bp, C. elegans
ttcttgacaattt

SEQ ID NO: 736586 - DNA, 13 bp, C. elegans
ttcttgagaaatt

SEQ ID NO: 736587 - DNA, 13 bp, C. elegans
ttcttgagaattt

SEQ ID NO: 736588 - DNA, 13 bp, C. elegans
ttcttgagattca

SEQ ID NO: 736589 - DNA, 13 bp, C. elegans
ttcttgataaaaa

SEQ ID NO: 736590 - DNA, 13 bp, C. elegans
ttcttgatattct

SEQ ID NO: 736591 - DNA, 13 bp, C. elegans
ttcttgatttcaa

SEQ ID NO: 736592 - DNA, 13 bp, C. elegans
ttcttgatttcat

SEQ ID NO: 736593 - DNA, 13 bp, C. elegans
ttcttgcactttt

SEQ ID NO: 736594 - DNA, 13 bp, C. elegans
ttcttgcattttc

SEQ ID NO: 736595 - DNA, 13 bp, C. elegans
ttcttgcgaaaat

SEQ ID NO: 736596 - DNA, 13 bp, C. elegans
ttcttgcgaaatt

SEQ ID NO: 736597 - DNA, 13 bp, C. elegans
ttcttgctcaaaa

SEQ ID NO: 736598 - DNA, 13 bp, C. elegans
ttcttggaaaaac

SEQ ID NO: 736599 - DNA, 13 bp, C. elegans
ttcttggaaaaat

SEQ ID NO: 736600 - DNA, 13 bp, C. elegans
ttcttggaaaaca

SEQ ID NO: 736601 - DNA, 13 bp, C. elegans
ttcttggaaaact

SEQ ID NO: 736602 - DNA, 13 bp, C. elegans
ttcttggaaaata

SEQ ID NO: 736603 - DNA, 13 bp, C. elegans
ttcttggaatttt

SEQ ID NO: 736604 - DNA, 13 bp, C. elegans
ttcttgggatttt

SEQ ID NO: 736605 - DNA, 13 bp, C. elegans
ttcttggtggcct

SEQ ID NO: 736606 - DNA, 13 bp, C. elegans
ttcttgtaaaact

SEQ ID NO: 736607 - DNA, 13 bp, C. elegans
ttcttgtaaaata

SEQ ID NO: 736608 - DNA, 13 bp, C. elegans
ttcttgtagatca

SEQ ID NO: 736609 - DNA, 13 bp, C. elegans
ttcttgtcaaaat

SEQ ID NO: 736610 - DNA, 13 bp, C. elegans
ttcttgtctgaaa

SEQ ID NO: 736611 - DNA, 13 bp, C. elegans
ttcttgtgacaaa

SEQ ID NO: 736612 - DNA, 13 bp, C. elegans
ttcttgttcaaaa

SEQ ID NO: 736613 - DNA, 13 bp, C. elegans
ttcttgttggaaa

SEQ ID NO: 736614 - DNA, 13 bp, C. elegans
ttcttgtttcaat

SEQ ID NO: 736615 - DNA, 13 bp, C. elegans
ttctttaaaacta

SEQ ID NO: 736616 - DNA, 13 bp, C. elegans
ttctttaaaagaa

SEQ ID NO: 736617 - DNA, 13 bp, C. elegans
ttctttaaaagtt

SEQ ID NO: 736618 - DNA, 13 bp, C. elegans
ttctttaaatgac

SEQ ID NO: 736619 - DNA, 13 bp, C. elegans
ttctttaaattac

SEQ ID NO: 736620 - DNA, 13 bp, C. elegans
ttctttaaattca

SEQ ID NO: 736621 - DNA, 13 bp, C. elegans
ttctttaaattcc

SEQ ID NO: 736622 - DNA, 13 bp, C. elegans
ttctttatgaaat

SEQ ID NO: 736623 - DNA, 13 bp, C. elegans
ttctttatttgaa

SEQ ID NO: 736624 - DNA, 13 bp, C. elegans
ttctttcaaaatt

SEQ ID NO: 736625 - DNA, 13 bp, C. elegans
ttctttcaaagtt

SEQ ID NO: 736626 - DNA, 13 bp, C. elegans
ttctttcaaatga

SEQ ID NO: 736627 - DNA, 13 bp, C. elegans
ttctttcaacaaa

SEQ ID NO: 736628 - DNA, 13 bp, C. elegans
ttctttcagattt

SEQ ID NO: 736629 - DNA, 13 bp, C. elegans
ttctttcagtatt

SEQ ID NO: 736630 - DNA, 13 bp, C. elegans
ttctttcagtttc

SEQ ID NO: 736631 - DNA, 13 bp, C. elegans
ttctttccaaaaa

SEQ ID NO: 736632 - DNA, 13 bp, C. elegans
ttctttctaataa

SEQ ID NO: 736633 - DNA, 13 bp, C. elegans
ttctttctgaatt

SEQ ID NO: 736634 - DNA, 13 bp, C. elegans
ttctttgaaaagt

SEQ ID NO: 736635 - DNA, 13 bp, C. elegans
ttctttgaaaatt

SEQ ID NO: 736636 - DNA, 14 bp, C. elegans
ttctttgaaattta

SEQ ID NO: 736637 - DNA, 13 bp, C. elegans
ttctttgaagaaa

SEQ ID NO: 736638 - DNA, 13 bp, C. elegans
ttctttgaagaat

SEQ ID NO: 736639 - DNA, 13 bp, C. elegans
ttctttgaattgt

SEQ ID NO: 736640 - DNA, 13 bp, C. elegans
ttctttgaattta

SEQ ID NO: 736641 - DNA, 13 bp, C. elegans
ttctttgacaaat

SEQ ID NO: 736642 - DNA, 13 bp, C. elegans
ttctttgagattt

SEQ ID NO: 736643 - DNA, 13 bp, C. elegans
ttctttgatttca

SEQ ID NO: 736644 - DNA, 13 bp, C. elegans
ttctttggaaatt

SEQ ID NO: 736645 - DNA, 13 bp, C. elegans
ttctttgttaaaa

SEQ ID NO: 736646 - DNA, 13 bp, C. elegans
ttcttttaaatgt

SEQ ID NO: 736647 - DNA, 13 bp, C. elegans
ttcttttacaaat

SEQ ID NO: 736648 - DNA, 13 bp, C. elegans
ttcttttcaaaca

SEQ ID NO: 736649 - DNA, 13 bp, C. elegans
ttcttttcaagtt

SEQ ID NO: 736650 - DNA, 13 bp, C. elegans
ttcttttcaatgt

SEQ ID NO: 736651 - DNA, 13 bp, C. elegans
ttcttttcacaaa

SEQ ID NO: 736652 - DNA, 13 bp, C. elegans
ttcttttcgaaat

SEQ ID NO: 736653 - DNA, 13 bp, C. elegans
ttcttttcgaata

SEQ ID NO: 736654 - DNA, 13 bp, C. elegans
ttcttttctagaa

SEQ ID NO: 736655 - DNA, 13 bp, C. elegans
ttcttttgaaaaa

SEQ ID NO: 736656 - DNA, 13 bp, C. elegans
ttcttttgaaaat

SEQ ID NO: 736657 - DNA, 13 bp, C. elegans
ttcttttggaatt

SEQ ID NO: 736658 - DNA, 13 bp, C. elegans
ttcttttggagct

SEQ ID NO: 736659 - DNA, 13 bp, C. elegans
ttctttttcacaa

SEQ ID NO: 736660 - DNA, 13 bp, C. elegans
ttctttttcgaaa

SEQ ID NO: 736661 - DNA, 13 bp, C. elegans
ttctttttgagat

SEQ ID NO: 736662 - DNA, 13 bp, C. elegans
ttcttttttgaag

SEQ ID NO: 736663 - DNA, 13 bp, C. elegans
ttcttttttgaca

SEQ ID NO: 736664 - DNA, 13 bp, C. elegans
ttcttttttgcaa

SEQ ID NO: 736665 - DNA, 13 bp, C. elegans
ttgaaaaaaaacg

SEQ ID NO: 736666 - DNA, 13 bp, C. elegans
ttgaaaaaaaact

SEQ ID NO: 736667 - DNA, 13 bp, C. elegans
ttgaaaaaaaagc

SEQ ID NO: 736668 - DNA, 13 bp, C. elegans
ttgaaaaaaaatc

SEQ ID NO: 736669 - DNA, 13 bp, C. elegans
ttgaaaaaaactt

SEQ ID NO: 736670 - DNA, 13 bp, C. elegans
ttgaaaaaaatca

SEQ ID NO: 736671 - DNA, 13 bp, C. elegans
ttgaaaaaaattc

SEQ ID NO: 736672 - DNA, 13 bp, C. elegans
ttgaaaaaacaat

SEQ ID NO: 736673 - DNA, 13 bp, C. elegans
ttgaaaaaacatt

SEQ ID NO: 736674 - DNA, 13 bp, C. elegans
ttgaaaaaaccga

SEQ ID NO: 736675 - DNA, 13 bp, C. elegans
ttgaaaaaacttt

SEQ ID NO: 736676 - DNA, 13 bp, C. elegans
ttgaaaaaagagc

SEQ ID NO: 736677 - DNA, 13 bp, C. elegans
ttgaaaaaagtgt

SEQ ID NO: 736678 - DNA, 13 bp, C. elegans
ttgaaaaaagttt

SEQ ID NO: 736679 - DNA, 13 bp, C. elegans
ttgaaaaaatacc

SEQ ID NO: 736680 - DNA, 13 bp, C. elegans
ttgaaaaaatcag

SEQ ID NO: 736681 - DNA, 13 bp, C. elegans
ttgaaaaaatcat

SEQ ID NO: 736682 - DNA, 13 bp, C. elegans
ttgaaaaaatccc

SEQ ID NO: 736683 - DNA, 13 bp, C. elegans
ttgaaaaaatcga

SEQ ID NO: 736684 - DNA, 13 bp, C. elegans
ttgaaaaaatctc

SEQ ID NO: 736685 - DNA, 13 bp, C. elegans
ttgaaaaaatctt

SEQ ID NO: 736686 - DNA, 13 bp, C. elegans
ttgaaaaaattac

SEQ ID NO: 736687 - DNA, 13 bp, C. elegans
ttgaaaaacaatt

SEQ ID NO: 736688 - DNA, 13 bp, C. elegans
ttgaaaaacatgc

SEQ ID NO: 736689 - DNA, 13 bp, C. elegans
ttgaaaaaccaaa

SEQ ID NO: 736690 - DNA, 13 bp, C. elegans
ttgaaaaacgcaa

SEQ ID NO: 736691 - DNA, 13 bp, C. elegans
ttgaaaaacgttt

SEQ ID NO: 736692 - DNA, 13 bp, C. elegans
ttgaaaaactaat

SEQ ID NO: 736693 - DNA, 13 bp, C. elegans
ttgaaaaacttac

SEQ ID NO: 736694 - DNA, 13 bp, C. elegans
ttgaaaaagtaga

SEQ ID NO: 736695 - DNA, 13 bp, C. elegans
ttgaaaaagtggt

SEQ ID NO: 736696 - DNA, 13 bp, C. elegans
ttgaaaaagttaa

SEQ ID NO: 736697 - DNA, 13 bp, C. elegans
ttgaaaaagttca

SEQ ID NO: 736698 - DNA, 13 bp, C. elegans
ttgaaaaagtttt

SEQ ID NO: 736699 - DNA, 13 bp, C. elegans
ttgaaaaatacaa

SEQ ID NO: 736700 - DNA, 13 bp, C. elegans
ttgaaaaatacga

SEQ ID NO: 736701 - DNA, 13 bp, C. elegans
ttgaaaaatagta

SEQ ID NO: 736702 - DNA, 13 bp, C. elegans
ttgaaaaatatga

SEQ ID NO: 736703 - DNA, 13 bp, C. elegans
ttgaaaaatatgc

SEQ ID NO: 736704 - DNA, 13 bp, C. elegans
ttgaaaaatattc

SEQ ID NO: 736705 - DNA, 13 bp, C. elegans
ttgaaaaatcatc

SEQ ID NO: 736706 - DNA, 13 bp, C. elegans
ttgaaaaatccaa

SEQ ID NO: 736707 - DNA, 13 bp, C. elegans
ttgaaaaatccct

SEQ ID NO: 736708 - DNA, 13 bp, C. elegans
ttgaaaaatcgag

SEQ ID NO: 736709 - DNA, 13 bp, C. elegans
ttgaaaaatctat

SEQ ID NO: 736710 - DNA, 13 bp, C. elegans
ttgaaaaatctca

SEQ ID NO: 736711 - DNA, 13 bp, C. elegans
ttgaaaaatctgt

SEQ ID NO: 736712 - DNA, 13 bp, C. elegans
ttgaaaaatgaca

SEQ ID NO: 736713 - DNA, 13 bp, C. elegans
ttgaaaaatgcaa

SEQ ID NO: 736714 - DNA, 13 bp, C. elegans
ttgaaaaatgctc

SEQ ID NO: 736715 - DNA, 13 bp, C. elegans
ttgaaaaatggaa

SEQ ID NO: 736716 - DNA, 13 bp, C. elegans
ttgaaaaatgtga

SEQ ID NO: 736717 - DNA, 13 bp, C. elegans
ttgaaaaattagt

SEQ ID NO: 736718 - DNA, 13 bp, C. elegans
ttgaaaaattcaa

SEQ ID NO: 736719 - DNA, 13 bp, C. elegans
ttgaaaaattcta

SEQ ID NO: 736720 - DNA, 13 bp, C. elegans
ttgaaaaattgga

SEQ ID NO: 736721 - DNA, 13 bp, C. elegans
ttgaaaaattggt

SEQ ID NO: 736722 - DNA, 13 bp, C. elegans
ttgaaaaatttag

SEQ ID NO: 736723 - DNA, 13 bp, C. elegans
ttgaaaaatttgg

SEQ ID NO: 736724 - DNA, 13 bp, C. elegans
ttgaaaacaaaat

SEQ ID NO: 736725 - DNA, 13 bp, C. elegans
ttgaaaacaaatg

SEQ ID NO: 736726 - DNA, 13 bp, C. elegans
ttgaaaacaagaa

SEQ ID NO: 736727 - DNA, 13 bp, C. elegans
ttgaaaacaagat

SEQ ID NO: 736728 - DNA, 13 bp, C. elegans
ttgaaaacacaat

SEQ ID NO: 736729 - DNA, 13 bp, C. elegans
ttgaaaacagcat

SEQ ID NO: 736730 - DNA, 13 bp, C. elegans
ttgaaaacattct

SEQ ID NO: 736731 - DNA, 13 bp, C. elegans
ttgaaaacattga

SEQ ID NO: 736732 - DNA, 13 bp, C. elegans
ttgaaaacattta

SEQ ID NO: 736733 - DNA, 13 bp, C. elegans
ttgaaaacatttt

SEQ ID NO: 736734 - DNA, 13 bp, C. elegans
ttgaaaaccaaat

SEQ ID NO: 736735 - DNA, 13 bp, C. elegans
ttgaaaaccacaa

SEQ ID NO: 736736 - DNA, 13 bp, C. elegans
ttgaaaaccagtt

SEQ ID NO: 736737 - DNA, 13 bp, C. elegans
ttgaaaaccatca

SEQ ID NO: 736738 - DNA, 13 bp, C. elegans
ttgaaaaccattt

SEQ ID NO: 736739 - DNA, 13 bp, C. elegans
ttgaaaacccaat

SEQ ID NO: 736740 - DNA, 13 bp, C. elegans
ttgaaaaccccaa

SEQ ID NO: 736741 - DNA, 13 bp, C. elegans
ttgaaaacgctcc

SEQ ID NO: 736742 - DNA, 13 bp, C. elegans
ttgaaaactaaaa

SEQ ID NO: 736743 - DNA, 13 bp, C. elegans
ttgaaaactaatt

SEQ ID NO: 736744 - DNA, 13 bp, C. elegans
ttgaaaactacaa

SEQ ID NO: 736745 - DNA, 13 bp, C. elegans
ttgaaaactactc

SEQ ID NO: 736746 - DNA, 13 bp, C. elegans
ttgaaaactagtt

SEQ ID NO: 736747 - DNA, 13 bp, C. elegans
ttgaaaactatga

SEQ ID NO: 736748 - DNA, 13 bp, C. elegans
ttgaaaactattt

SEQ ID NO: 736749 - DNA, 13 bp, C. elegans
ttgaaaactcaaa

SEQ ID NO: 736750 - DNA, 13 bp, C. elegans
ttgaaaactcttc

SEQ ID NO: 736751 - DNA, 13 bp, C. elegans
ttgaaaactcttt

SEQ ID NO: 736752 - DNA, 13 bp, C. elegans
ttgaaaactgaat

SEQ ID NO: 736753 - DNA, 23 bp, C. elegans
ttgaaaactgaccgagttatgat

SEQ ID NO: 736754 - DNA, 13 bp, C. elegans
ttgaaaactgaga

SEQ ID NO: 736755 - DNA, 13 bp, C. elegans
ttgaaaacttcaa

SEQ ID NO: 736756 - DNA, 13 bp, C. elegans
ttgaaaacttctt

SEQ ID NO: 736757 - DNA, 13 bp, C. elegans
ttgaaaacttgtg

SEQ ID NO: 736758 - DNA, 13 bp, C. elegans
ttgaaaacttgtt

SEQ ID NO: 736759 - DNA, 13 bp, C. elegans
ttgaaaacttttg

SEQ ID NO: 736760 - DNA, 13 bp, C. elegans
ttgaaaacttttt

SEQ ID NO: 736761 - DNA, 13 bp, C. elegans
ttgaaaagaaaac

SEQ ID NO: 736762 - DNA, 13 bp, C. elegans
ttgaaaagaagta

SEQ ID NO: 736763 - DNA, 13 bp, C. elegans
ttgaaaagaatat

SEQ ID NO: 736764 - DNA, 13 bp, C. elegans
ttgaaaagattat

SEQ ID NO: 736765 - DNA, 13 bp, C. elegans
ttgaaaagatttt

SEQ ID NO: 736766 - DNA, 13 bp, C. elegans
ttgaaaagctcca

SEQ ID NO: 736767 - DNA, 13 bp, C. elegans
ttgaaaaggaaat

SEQ ID NO: 736768 - DNA, 13 bp, C. elegans
ttgaaaagggaaa

SEQ ID NO: 736769 - DNA, 13 bp, C. elegans
ttgaaaagtattc

SEQ ID NO: 736770 - DNA, 13 bp, C. elegans
ttgaaaagtattt

SEQ ID NO: 736771 - DNA, 13 bp, C. elegans
ttgaaaagtgaaa

SEQ ID NO: 736772 - DNA, 13 bp, C. elegans
ttgaaaagttcaa

SEQ ID NO: 736773 - DNA, 13 bp, C. elegans
ttgaaaagttcag

SEQ ID NO: 736774 - DNA, 13 bp, C. elegans
ttgaaaagttctc

SEQ ID NO: 736775 - DNA, 13 bp, C. elegans
ttgaaaagttgaa

SEQ ID NO: 736776 - DNA, 13 bp, C. elegans
ttgaaaagtttga

SEQ ID NO: 736777 - DNA, 13 bp, C. elegans
ttgaaaataagga

SEQ ID NO: 736778 - DNA, 13 bp, C. elegans
ttgaaaatacatt

SEQ ID NO: 736779 - DNA, 13 bp, C. elegans
ttgaaaatagttg

SEQ ID NO: 736780 - DNA, 13 bp, C. elegans
ttgaaaatagttt

SEQ ID NO: 736781 - DNA, 13 bp, C. elegans
ttgaaaatatcaa

SEQ ID NO: 736782 - DNA, 13 bp, C. elegans
ttgaaaatatccg

SEQ ID NO: 736783 - DNA, 13 bp, C. elegans
ttgaaaatatgtt

SEQ ID NO: 736784 - DNA, 13 bp, C. elegans
ttgaaaatattga

SEQ ID NO: 736785 - DNA, 13 bp, C. elegans
ttgaaaatcaaaa

SEQ ID NO: 736786 - DNA, 13 bp, C. elegans
ttgaaaatcaact

SEQ ID NO: 736787 - DNA, 13 bp, C. elegans
ttgaaaatcaagc

SEQ ID NO: 736788 - DNA, 13 bp, C. elegans
ttgaaaatcaatt

SEQ ID NO: 736789 - DNA, 13 bp, C. elegans
ttgaaaatcagtg

SEQ ID NO: 736790 - DNA, 13 bp, C. elegans
ttgaaaatccaaa

SEQ ID NO: 736791 - DNA, 13 bp, C. elegans
ttgaaaatcgaaa

SEQ ID NO: 736792 - DNA, 13 bp, C. elegans
ttgaaaatcgcca

SEQ ID NO: 736793 - DNA, 13 bp, C. elegans
ttgaaaatcgttt

SEQ ID NO: 736794 - DNA, 13 bp, C. elegans
ttgaaaatctgaa

SEQ ID NO: 736795 - DNA, 13 bp, C. elegans
ttgaaaatcttaa

SEQ ID NO: 736796 - DNA, 13 bp, C. elegans
ttgaaaatctttt

SEQ ID NO: 736797 - DNA, 13 bp, C. elegans
ttgaaaatgaaac

SEQ ID NO: 736798 - DNA, 13 bp, C. elegans
ttgaaaatgaaca

SEQ ID NO: 736799 - DNA, 13 bp, C. elegans
ttgaaaatgaact

SEQ ID NO: 736800 - DNA, 13 bp, C. elegans
ttgaaaatgaaga

SEQ ID NO: 736801 - DNA, 13 bp, C. elegans
ttgaaaatgaatt

SEQ ID NO: 736802 - DNA, 13 bp, C. elegans
ttgaaaatgagca

SEQ ID NO: 736803 - DNA, 13 bp, C. elegans
ttgaaaatgagtt

SEQ ID NO: 736804 - DNA, 13 bp, C. elegans
ttgaaaatgatta

SEQ ID NO: 736805 - DNA, 13 bp, C. elegans
ttgaaaatgcaaa

SEQ ID NO: 736806 - DNA, 13 bp, C. elegans
ttgaaaatgcact

SEQ ID NO: 736807 - DNA, 13 bp, C. elegans
ttgaaaatgctaa

SEQ ID NO: 736808 - DNA, 13 bp, C. elegans
ttgaaaatgctgt

SEQ ID NO: 736809 - DNA, 13 bp, C. elegans
ttgaaaatggatt

SEQ ID NO: 736810 - DNA, 13 bp, C. elegans
ttgaaaatgtata

SEQ ID NO: 736811 - DNA, 13 bp, C. elegans
ttgaaaatgtgga

SEQ ID NO: 736812 - DNA, 13 bp, C. elegans
ttgaaaatgtgtt

SEQ ID NO: 736813 - DNA, 13 bp, C. elegans
ttgaaaatgttcc

SEQ ID NO: 736814 - DNA, 14 bp, C. elegans
ttgaaaatgttgtg

SEQ ID NO: 736815 - DNA, 13 bp, C. elegans
ttgaaaatgtttc

SEQ ID NO: 736816 - DNA, 13 bp, C. elegans
ttgaaaattcaaa

SEQ ID NO: 736817 - DNA, 13 bp, C. elegans
ttgaaaattcata

SEQ ID NO: 736818 - DNA, 13 bp, C. elegans
ttgaaaattcgaa

SEQ ID NO: 736819 - DNA, 14 bp, C. elegans
ttgaaaattctaaa

SEQ ID NO: 736820 - DNA, 13 bp, C. elegans
ttgaaaattcttt

SEQ ID NO: 736821 - DNA, 13 bp, C. elegans
ttgaaaattgcta

SEQ ID NO: 736822 - DNA, 13 bp, C. elegans
ttgaaaattgggt

SEQ ID NO: 736823 - DNA, 13 bp, C. elegans
ttgaaaattgtat

SEQ ID NO: 736824 - DNA, 13 bp, C. elegans
ttgaaaattgtga

SEQ ID NO: 736825 - DNA, 13 bp, C. elegans
ttgaaaatttccg

SEQ ID NO: 736826 - DNA, 14 bp, C. elegans
ttgaaaatttgaat

SEQ ID NO: 736827 - DNA, 13 bp, C. elegans
ttgaaaatttgag

SEQ ID NO: 736828 - DNA, 13 bp, C. elegans
ttgaaaatttgct

SEQ ID NO: 736829 - DNA, 13 bp, C. elegans
ttgaaaatttgga

SEQ ID NO: 736830 - DNA, 13 bp, C. elegans
ttgaaaattttca

SEQ ID NO: 736831 - DNA, 13 bp, C. elegans
ttgaaaattttgg

SEQ ID NO: 736832 - DNA, 13 bp, C. elegans
ttgaaaatttttg

SEQ ID NO: 736833 - DNA, 13 bp, C. elegans
ttgaaacaaaaat

SEQ ID NO: 736834 - DNA, 13 bp, C. elegans
ttgaaacaaaacc

SEQ ID NO: 736835 - DNA, 13 bp, C. elegans
ttgaaacaaaact

SEQ ID NO: 736836 - DNA, 13 bp, C. elegans
ttgaaacaaaata

SEQ ID NO: 736837 - DNA, 13 bp, C. elegans
ttgaaacaaactt

SEQ ID NO: 736838 - DNA, 13 bp, C. elegans
ttgaaacaaagtt

SEQ ID NO: 736839 - DNA, 13 bp, C. elegans
ttgaaacaaatct

SEQ ID NO: 736840 - DNA, 13 bp, C. elegans
ttgaaacaaatgt

SEQ ID NO: 736841 - DNA, 13 bp, C. elegans
ttgaaacaattat

SEQ ID NO: 736842 - DNA, 13 bp, C. elegans
ttgaaacaatttt

SEQ ID NO: 736843 - DNA, 13 bp, C. elegans
ttgaaacagaaat

SEQ ID NO: 736844 - DNA, 13 bp, C. elegans
ttgaaacagaatt

SEQ ID NO: 736845 - DNA, 17 bp, C. elegans
ttgaaacagacttgaac

SEQ ID NO: 736846 - DNA, 13 bp, C. elegans
ttgaaacagcatt

SEQ ID NO: 736847 - DNA, 13 bp, C. elegans
ttgaaacatatat

SEQ ID NO: 736848 - DNA, 13 bp, C. elegans
ttgaaacatcata

SEQ ID NO: 736849 - DNA, 13 bp, C. elegans
ttgaaacatgaag

SEQ ID NO: 736850 - DNA, 13 bp, C. elegans
ttgaaacatgcat

SEQ ID NO: 736851 - DNA, 13 bp, C. elegans
ttgaaacattcat

SEQ ID NO: 736852 - DNA, 13 bp, C. elegans
ttgaaacattcca

SEQ ID NO: 736853 - DNA, 13 bp, C. elegans
ttgaaacattctt

SEQ ID NO: 736854 - DNA, 13 bp, C. elegans
ttgaaacattgta

SEQ ID NO: 736855 - DNA, 13 bp, C. elegans
ttgaaacatttca

SEQ ID NO: 736856 - DNA, 13 bp, C. elegans
ttgaaacattttc

SEQ ID NO: 736857 - DNA, 13 bp, C. elegans
ttgaaacattttt

SEQ ID NO: 736858 - DNA, 13 bp, C. elegans
ttgaaaccaaatt

SEQ ID NO: 736859 - DNA, 13 bp, C. elegans
ttgaaaccaacaa

SEQ ID NO: 736860 - DNA, 13 bp, C. elegans
ttgaaaccaactc

SEQ ID NO: 736861 - DNA, 13 bp, C. elegans
ttgaaaccaggaa

SEQ ID NO: 736862 - DNA, 13 bp, C. elegans
ttgaaaccatttt

SEQ ID NO: 736863 - DNA, 13 bp, C. elegans
ttgaaaccgtttt

SEQ ID NO: 736864 - DNA, 13 bp, C. elegans
ttgaaacctgttt

SEQ ID NO: 736865 - DNA, 13 bp, C. elegans
ttgaaacgtgaaa

SEQ ID NO: 736866 - DNA, 13 bp, C. elegans
ttgaaactaataa

SEQ ID NO: 736867 - DNA, 13 bp, C. elegans
ttgaaactaattt

SEQ ID NO: 736868 - DNA, 13 bp, C. elegans
ttgaaactactgt

SEQ ID NO: 736869 - DNA, 13 bp, C. elegans
ttgaaactagatt

SEQ ID NO: 736870 - DNA, 13 bp, C. elegans
ttgaaactattga

SEQ ID NO: 736871 - DNA, 13 bp, C. elegans
ttgaaactcaatt

SEQ ID NO: 736872 - DNA, 13 bp, C. elegans
ttgaaactccatt

SEQ ID NO: 736873 - DNA, 13 bp, C. elegans
ttgaaactgaaag

SEQ ID NO: 736874 - DNA, 13 bp, C. elegans
ttgaaactgttaa

SEQ ID NO: 736875 - DNA, 13 bp, C. elegans
ttgaaactgtttt

SEQ ID NO: 736876 - DNA, 13 bp, C. elegans
ttgaaacttcaaa

SEQ ID NO: 736877 - DNA, 13 bp, C. elegans
ttgaaacttctct

SEQ ID NO: 736878 - DNA, 13 bp, C. elegans
ttgaaacttgaga

SEQ ID NO: 736879 - DNA, 13 bp, C. elegans
ttgaaactttcaa

SEQ ID NO: 736880 - DNA, 13 bp, C. elegans
ttgaaactttgaa

SEQ ID NO: 736881 - DNA, 13 bp, C. elegans
ttgaaactttgat

SEQ ID NO: 736882 - DNA, 13 bp, C. elegans
ttgaaacttttac

SEQ ID NO: 736883 - DNA, 13 bp, C. elegans
ttgaaacttttca

SEQ ID NO: 736884 - DNA, 13 bp, C. elegans
ttgaaacttttga

SEQ ID NO: 736885 - DNA, 13 bp, C. elegans
ttgaaactttttt

SEQ ID NO: 736886 - DNA, 13 bp, C. elegans
ttgaaagaaaatc

SEQ ID NO: 736887 - DNA, 13 bp, C. elegans
ttgaaagaaacta

SEQ ID NO: 736888 - DNA, 13 bp, C. elegans
ttgaaagaaatga

SEQ ID NO: 736889 - DNA, 13 bp, C. elegans
ttgaaagaaattg

SEQ ID NO: 736890 - DNA, 13 bp, C. elegans
ttgaaagatcaaa

SEQ ID NO: 736891 - DNA, 13 bp, C. elegans
ttgaaagcatttt

SEQ ID NO: 736892 - DNA, 13 bp, C. elegans
ttgaaagctattt

SEQ ID NO: 736893 - DNA, 13 bp, C. elegans
ttgaaagctgaaa

SEQ ID NO: 736894 - DNA, 13 bp, C. elegans
ttgaaagcttttt

SEQ ID NO: 736895 - DNA, 13 bp, C. elegans
ttgaaagggaaaa

SEQ ID NO: 736896 - DNA, 13 bp, C. elegans
ttgaaagtgaaat

SEQ ID NO: 736897 - DNA, 13 bp, C. elegans
ttgaaagtgagaa

SEQ ID NO: 736898 - DNA, 13 bp, C. elegans
ttgaaagtgccaa

SEQ ID NO: 736899 - DNA, 13 bp, C. elegans
ttgaaagtgttcc

SEQ ID NO: 736900 - DNA, 13 bp, C. elegans
ttgaaagttcaaa

SEQ ID NO: 736901 - DNA, 13 bp, C. elegans
ttgaaagttgaaa

SEQ ID NO: 736902 - DNA, 13 bp, C. elegans
ttgaaagtttccg

SEQ ID NO: 736903 - DNA, 13 bp, C. elegans
ttgaaagtttgat

SEQ ID NO: 736904 - DNA, 13 bp, C. elegans
ttgaaagttttaa

SEQ ID NO: 736905 - DNA, 13 bp, C. elegans
ttgaaagttttcg

SEQ ID NO: 736906 - DNA, 13 bp, C. elegans
ttgaaagtttttc

SEQ ID NO: 736907 - DNA, 13 bp, C. elegans
ttgaaataaaact

SEQ ID NO: 736908 - DNA, 13 bp, C. elegans
ttgaaataaatac

SEQ ID NO: 736909 - DNA, 13 bp, C. elegans
ttgaaataagaat

SEQ ID NO: 736910 - DNA, 13 bp, C. elegans
ttgaaataagttt

SEQ ID NO: 736911 - DNA, 13 bp, C. elegans
ttgaaataatctt

SEQ ID NO: 736912 - DNA, 13 bp, C. elegans
ttgaaataattac

SEQ ID NO: 736913 - DNA, 13 bp, C. elegans
ttgaaataattgc

SEQ ID NO: 736914 - DNA, 13 bp, C. elegans
ttgaaatacaaaa

SEQ ID NO: 736915 - DNA, 13 bp, C. elegans
ttgaaatacaatt

SEQ ID NO: 736916 - DNA, 13 bp, C. elegans
ttgaaatacagtt

SEQ ID NO: 736917 - DNA, 13 bp, C. elegans
ttgaaatagattt

SEQ ID NO: 736918 - DNA, 13 bp, C. elegans
ttgaaatagttat

SEQ ID NO: 736919 - DNA, 13 bp, C. elegans
ttgaaatataact

SEQ ID NO: 736920 - DNA, 13 bp, C. elegans
ttgaaatatattc

SEQ ID NO: 736921 - DNA, 13 bp, C. elegans
ttgaaatatcaaa

SEQ ID NO: 736922 - DNA, 13 bp, C. elegans
ttgaaatatcata

SEQ ID NO: 736923 - DNA, 13 bp, C. elegans
ttgaaatatgaaa

SEQ ID NO: 736924 - DNA, 13 bp, C. elegans
ttgaaatatgaga

SEQ ID NO: 736925 - DNA, 13 bp, C. elegans
ttgaaatattcca

SEQ ID NO: 736926 - DNA, 13 bp, C. elegans
ttgaaatattctc

SEQ ID NO: 736927 - DNA, 13 bp, C. elegans
ttgaaatattgga

SEQ ID NO: 736928 - DNA, 13 bp, C. elegans
ttgaaatcaaaga

SEQ ID NO: 736929 - DNA, 13 bp, C. elegans
ttgaaatcaaatt

SEQ ID NO: 736930 - DNA, 13 bp, C. elegans
ttgaaatcaactt

SEQ ID NO: 736931 - DNA, 13 bp, C. elegans
ttgaaatcattaa

SEQ ID NO: 736932 - DNA, 13 bp, C. elegans
ttgaaatcgataa

SEQ ID NO: 736933 - DNA, 13 bp, C. elegans
ttgaaatcgcaag

SEQ ID NO: 736934 - DNA, 13 bp, C. elegans
ttgaaatcgcgaa

SEQ ID NO: 736935 - DNA, 13 bp, C. elegans
ttgaaatctcatt

SEQ ID NO: 736936 - DNA, 13 bp, C. elegans
ttgaaatctgaaa

SEQ ID NO: 736937 - DNA, 13 bp, C. elegans
ttgaaatctttct

SEQ ID NO: 736938 - DNA, 13 bp, C. elegans
ttgaaatcttttt

SEQ ID NO: 736939 - DNA, 13 bp, C. elegans
ttgaaatgaaatg

SEQ ID NO: 736940 - DNA, 13 bp, C. elegans
ttgaaatgaagaa

SEQ ID NO: 736941 - DNA, 13 bp, C. elegans
ttgaaatgaattc

SEQ ID NO: 736942 - DNA, 13 bp, C. elegans
ttgaaatgaattt

SEQ ID NO: 736943 - DNA, 13 bp, C. elegans
ttgaaatgacaat

SEQ ID NO: 736944 - DNA, 13 bp, C. elegans
ttgaaatgagtat

SEQ ID NO: 736945 - DNA, 13 bp, C. elegans
ttgaaatggaaat

SEQ ID NO: 736946 - DNA, 13 bp, C. elegans
ttgaaatggaatt

SEQ ID NO: 736947 - DNA, 13 bp, C. elegans
ttgaaatggattt

SEQ ID NO: 736948 - DNA, 13 bp, C. elegans
ttgaaatggttgt

SEQ ID NO: 736949 - DNA, 13 bp, C. elegans
ttgaaatgtacaa

SEQ ID NO: 736950 - DNA, 13 bp, C. elegans
ttgaaatgtgttt

SEQ ID NO: 736951 - DNA, 13 bp, C. elegans
ttgaaatgttaat

SEQ ID NO: 736952 - DNA, 13 bp, C. elegans
ttgaaatgttctt

SEQ ID NO: 736953 - DNA, 13 bp, C. elegans
ttgaaatgttgta

SEQ ID NO: 736954 - DNA, 13 bp, C. elegans
ttgaaatgtttga

SEQ ID NO: 736955 - DNA, 13 bp, C. elegans
ttgaaatgttttg

SEQ ID NO: 736956 - DNA, 13 bp, C. elegans
ttgaaattacaaa

SEQ ID NO: 736957 - DNA, 13 bp, C. elegans
ttgaaattacagt

SEQ ID NO: 736958 - DNA, 13 bp, C. elegans
ttgaaattagaaa

SEQ ID NO: 736959 - DNA, 13 bp, C. elegans
ttgaaattatctt

SEQ ID NO: 736960 - DNA, 13 bp, C. elegans
ttgaaattattga

SEQ ID NO: 736961 - DNA, 13 bp, C. elegans
ttgaaattcaaac

SEQ ID NO: 736962 - DNA, 13 bp, C. elegans
ttgaaattcataa

SEQ ID NO: 736963 - DNA, 13 bp, C. elegans
ttgaaattcattt

SEQ ID NO: 736964 - DNA, 13 bp, C. elegans
ttgaaattccatt

SEQ ID NO: 736965 - DNA, 13 bp, C. elegans
ttgaaattcccac

SEQ ID NO: 736966 - DNA, 13 bp, C. elegans
ttgaaattcgaat

SEQ ID NO: 736967 - DNA, 13 bp, C. elegans
ttgaaattctatt

SEQ ID NO: 736968 - DNA, 13 bp, C. elegans
ttgaaattctcca

SEQ ID NO: 736969 - DNA, 13 bp, C. elegans
ttgaaattctcga

SEQ ID NO: 736970 - DNA, 13 bp, C. elegans
ttgaaattcttgt

SEQ ID NO: 736971 - DNA, 13 bp, C. elegans
ttgaaattgaaaa

SEQ ID NO: 736972 - DNA, 13 bp, C. elegans
ttgaaattgaaat

SEQ ID NO: 736973 - DNA, 13 bp, C. elegans
ttgaaattgaaca

SEQ ID NO: 736974 - DNA, 13 bp, C. elegans
ttgaaattgaagt

SEQ ID NO: 736975 - DNA, 13 bp, C. elegans
ttgaaattgatga

SEQ ID NO: 736976 - DNA, 13 bp, C. elegans
ttgaaattgcagt

SEQ ID NO: 736977 - DNA, 13 bp, C. elegans
ttgaaattgcatt

SEQ ID NO: 736978 - DNA, 14 bp, C. elegans
ttgaaattgctttt

SEQ ID NO: 736979 - DNA, 13 bp, C. elegans
ttgaaattggatt

SEQ ID NO: 736980 - DNA, 13 bp, C. elegans
ttgaaattgtata

SEQ ID NO: 736981 - DNA, 13 bp, C. elegans
ttgaaattgttga

SEQ ID NO: 736982 - DNA, 13 bp, C. elegans
ttgaaatttagaa

SEQ ID NO: 736983 - DNA, 13 bp, C. elegans
ttgaaatttatgt

SEQ ID NO: 736984 - DNA, 13 bp, C. elegans
ttgaaatttcagc

SEQ ID NO: 736985 - DNA, 13 bp, C. elegans
ttgaaatttccga

SEQ ID NO: 736986 - DNA, 13 bp, C. elegans
ttgaaatttccgg

SEQ ID NO: 736987 - DNA, 13 bp, C. elegans
ttgaaatttcgaa

SEQ ID NO: 736988 - DNA, 13 bp, C. elegans
ttgaaatttctaa

SEQ ID NO: 736989 - DNA, 13 bp, C. elegans
ttgaaatttctat

SEQ ID NO: 736990 - DNA, 13 bp, C. elegans
ttgaaatttctga

SEQ ID NO: 736991 - DNA, 14 bp, C. elegans
ttgaaatttgaaaa

SEQ ID NO: 736992 - DNA, 13 bp, C. elegans
ttgaaatttgaag

SEQ ID NO: 736993 - DNA, 13 bp, C. elegans
ttgaaatttgata

SEQ ID NO: 736994 - DNA, 13 bp, C. elegans
ttgaaatttgcag

SEQ ID NO: 736995 - DNA, 13 bp, C. elegans
ttgaaatttggaa

SEQ ID NO: 736996 - DNA, 13 bp, C. elegans
ttgaaatttggat

SEQ ID NO: 736997 - DNA, 13 bp, C. elegans
ttgaaatttggcc

SEQ ID NO: 736998 - DNA, 13 bp, C. elegans
ttgaaatttggta

SEQ ID NO: 736999 - DNA, 13 bp, C. elegans
ttgaaattttatg

SEQ ID NO: 737000 - DNA, 13 bp, C. elegans
ttgaaattttcaa

SEQ ID NO: 737001 - DNA, 13 bp, C. elegans
ttgaaattttcag

SEQ ID NO: 737002 - DNA, 14 bp, C. elegans
ttgaaattttctat

SEQ ID NO: 737003 - DNA, 13 bp, C. elegans
ttgaaattttctg

SEQ ID NO: 737004 - DNA, 13 bp, C. elegans
ttgaaattttgaa

SEQ ID NO: 737005 - DNA, 13 bp, C. elegans
ttgaaatttttcc

SEQ ID NO: 737006 - DNA, 13 bp, C. elegans
ttgaaattttttc

SEQ ID NO: 737007 - DNA, 13 bp, C. elegans
ttgaacaaaaaat

SEQ ID NO: 737008 - DNA, 13 bp, C. elegans
ttgaacaaaaagt

SEQ ID NO: 737009 - DNA, 13 bp, C. elegans
ttgaacaaaattt

SEQ ID NO: 737010 - DNA, 13 bp, C. elegans
ttgaacaaacaaa

SEQ ID NO: 737011 - DNA, 13 bp, C. elegans
ttgaacaaagtta

SEQ ID NO: 737012 - DNA, 13 bp, C. elegans
ttgaacaaagttt

SEQ ID NO: 737013 - DNA, 13 bp, C. elegans
ttgaacaaattga

SEQ ID NO: 737014 - DNA, 13 bp, C. elegans
ttgaacaactatt

SEQ ID NO: 737015 - DNA, 13 bp, C. elegans
ttgaacaactcaa

SEQ ID NO: 737016 - DNA, 13 bp, C. elegans
ttgaacaactttt

SEQ ID NO: 737017 - DNA, 13 bp, C. elegans
ttgaacaagattt

SEQ ID NO: 737018 - DNA, 13 bp, C. elegans
ttgaacaataaaa

SEQ ID NO: 737019 - DNA, 13 bp, C. elegans
ttgaacaatgaaa

SEQ ID NO: 737020 - DNA, 13 bp, C. elegans
ttgaacaattaaa

SEQ ID NO: 737021 - DNA, 13 bp, C. elegans
ttgaacaattgaa

SEQ ID NO: 737022 - DNA, 13 bp, C. elegans
ttgaacaatttca

SEQ ID NO: 737023 - DNA, 13 bp, C. elegans
ttgaacaatttga

SEQ ID NO: 737024 - DNA, 13 bp, C. elegans
ttgaacaattttc

SEQ ID NO: 737025 - DNA, 13 bp, C. elegans
ttgaacaattttt

SEQ ID NO: 737026 - DNA, 13 bp, C. elegans
ttgaacacatttt

SEQ ID NO: 737027 - DNA, 13 bp, C. elegans
ttgaacacttttt

SEQ ID NO: 737028 - DNA, 13 bp, C. elegans
ttgaacatatttt

SEQ ID NO: 737029 - DNA, 13 bp, C. elegans
ttgaacatcgaaa

SEQ ID NO: 737030 - DNA, 13 bp, C. elegans
ttgaacattccag

SEQ ID NO: 737031 - DNA, 13 bp, C. elegans
ttgaacattgaaa

SEQ ID NO: 737032 - DNA, 13 bp, C. elegans
ttgaacatttaaa

SEQ ID NO: 737033 - DNA, 13 bp, C. elegans
ttgaacatttccg

SEQ ID NO: 737034 - DNA, 13 bp, C. elegans
ttgaacatttggt

SEQ ID NO: 737035 - DNA, 13 bp, C. elegans
ttgaacatttgta

SEQ ID NO: 737036 - DNA, 13 bp, C. elegans
ttgaacattttca

SEQ ID NO: 737037 - DNA, 13 bp, C. elegans
ttgaaccaaatat

SEQ ID NO: 737038 - DNA, 13 bp, C. elegans
ttgaaccaccata

SEQ ID NO: 737039 - DNA, 13 bp, C. elegans
ttgaacctacagt

SEQ ID NO: 737040 - DNA, 13 bp, C. elegans
ttgaacgattttt

SEQ ID NO: 737041 - DNA, 13 bp, C. elegans
ttgaacgcaaaaa

SEQ ID NO: 737042 - DNA, 13 bp, C. elegans
ttgaactagaaaa

SEQ ID NO: 737043 - DNA, 13 bp, C. elegans
ttgaactcatttc

SEQ ID NO: 737044 - DNA, 13 bp, C. elegans
ttgaactgaaatt

SEQ ID NO: 737045 - DNA, 13 bp, C. elegans
ttgaactgataaa

SEQ ID NO: 737046 - DNA, 13 bp, C. elegans
ttgaacttaaatt

SEQ ID NO: 737047 - DNA, 13 bp, C. elegans
ttgaactttaaat

SEQ ID NO: 737048 - DNA, 13 bp, C. elegans
ttgaactttaata

SEQ ID NO: 737049 - DNA, 13 bp, C. elegans
ttgaactttatct

SEQ ID NO: 737050 - DNA, 13 bp, C. elegans
ttgaactttcaac

SEQ ID NO: 737051 - DNA, 13 bp, C. elegans
ttgaactttcaat

SEQ ID NO: 737052 - DNA, 13 bp, C. elegans
ttgaactttgata

SEQ ID NO: 737053 - DNA, 13 bp, C. elegans
ttgaacttttaaa

SEQ ID NO: 737054 - DNA, 13 bp, C. elegans
ttgaacttttatt

SEQ ID NO: 737055 - DNA, 13 bp, C. elegans
ttgaacttttcaa

SEQ ID NO: 737056 - DNA, 13 bp, C. elegans
ttgaacttttcag

SEQ ID NO: 737057 - DNA, 13 bp, C. elegans
ttgaacttttcct

SEQ ID NO: 737058 - DNA, 13 bp, C. elegans
ttgaacttttctt

SEQ ID NO: 737059 - DNA, 13 bp, C. elegans
ttgaacttttgaa

SEQ ID NO: 737060 - DNA, 13 bp, C. elegans
ttgaactttttaa

SEQ ID NO: 737061 - DNA, 13 bp, C. elegans
ttgaagaaaaatc

SEQ ID NO: 737062 - DNA, 13 bp, C. elegans
ttgaagaaaacac

SEQ ID NO: 737063 - DNA, 13 bp, C. elegans
ttgaagaaaacat

SEQ ID NO: 737064 - DNA, 13 bp, C. elegans
ttgaagaaaactg

SEQ ID NO: 737065 - DNA, 13 bp, C. elegans
ttgaagaaacatt

SEQ ID NO: 737066 - DNA, 13 bp, C. elegans
ttgaagaaagttg

SEQ ID NO: 737067 - DNA, 13 bp, C. elegans
ttgaagaaatcca

SEQ ID NO: 737068 - DNA, 13 bp, C. elegans
ttgaagaaatcta

SEQ ID NO: 737069 - DNA, 13 bp, C. elegans
ttgaagaaatctt

SEQ ID NO: 737070 - DNA, 13 bp, C. elegans
ttgaagaaattga

SEQ ID NO: 737071 - DNA, 13 bp, C. elegans
ttgaagaaattgg

SEQ ID NO: 737072 - DNA, 13 bp, C. elegans
ttgaagaaattgt

SEQ ID NO: 737073 - DNA, 13 bp, C. elegans
ttgaagaacaaaa

SEQ ID NO: 737074 - DNA, 13 bp, C. elegans
ttgaagaataatt

SEQ ID NO: 737075 - DNA, 13 bp, C. elegans
ttgaagaattaat

SEQ ID NO: 737076 - DNA, 13 bp, C. elegans
ttgaagaattact

SEQ ID NO: 737077 - DNA, 13 bp, C. elegans
ttgaagaatttca

SEQ ID NO: 737078 - DNA, 13 bp, C. elegans
ttgaagaatttga

SEQ ID NO: 737079 - DNA, 13 bp, C. elegans
ttgaagaattttc

SEQ ID NO: 737080 - DNA, 13 bp, C. elegans
ttgaagaattttt

SEQ ID NO: 737081 - DNA, 13 bp, C. elegans
ttgaagacaaatt

SEQ ID NO: 737082 - DNA, 13 bp, C. elegans
ttgaagacaatta

SEQ ID NO: 737083 - DNA, 13 bp, C. elegans
ttgaagaccaaaa

SEQ ID NO: 737084 - DNA, 13 bp, C. elegans
ttgaagagacgca

SEQ ID NO: 737085 - DNA, 13 bp, C. elegans
ttgaagagagaaa

SEQ ID NO: 737086 - DNA, 13 bp, C. elegans
ttgaagaggtatt

SEQ ID NO: 737087 - DNA, 13 bp, C. elegans
ttgaagagtttga

SEQ ID NO: 737088 - DNA, 13 bp, C. elegans
ttgaagagtttta

SEQ ID NO: 737089 - DNA, 13 bp, C. elegans
ttgaagataacaa

SEQ ID NO: 737090 - DNA, 13 bp, C. elegans
ttgaagataagaa

SEQ ID NO: 737091 - DNA, 13 bp, C. elegans
ttgaagataatat

SEQ ID NO: 737092 - DNA, 13 bp, C. elegans
ttgaagatatcaa

SEQ ID NO: 737093 - DNA, 13 bp, C. elegans
ttgaagatattaa

SEQ ID NO: 737094 - DNA, 13 bp, C. elegans
ttgaagatcaaaa

SEQ ID NO: 737095 - DNA, 13 bp, C. elegans
ttgaagatgaaaa

SEQ ID NO: 737096 - DNA, 13 bp, C. elegans
ttgaagattaaaa

SEQ ID NO: 737097 - DNA, 13 bp, C. elegans
ttgaagattggaa

SEQ ID NO: 737098 - DNA, 13 bp, C. elegans
ttgaagatttaaa

SEQ ID NO: 737099 - DNA, 13 bp, C. elegans
ttgaagatttccg

SEQ ID NO: 737100 - DNA, 13 bp, C. elegans
ttgaagatttgtt

SEQ ID NO: 737101 - DNA, 13 bp, C. elegans
ttgaagattttag

SEQ ID NO: 737102 - DNA, 13 bp, C. elegans
ttgaagattttat

SEQ ID NO: 737103 - DNA, 13 bp, C. elegans
ttgaagattttct

SEQ ID NO: 737104 - DNA, 13 bp, C. elegans
ttgaagcaaaata

SEQ ID NO: 737105 - DNA, 13 bp, C. elegans
ttgaagcacaaaa

SEQ ID NO: 737106 - DNA, 13 bp, C. elegans
ttgaagcataaaa

SEQ ID NO: 737107 - DNA, 13 bp, C. elegans
ttgaagccaaaaa

SEQ ID NO: 737108 - DNA, 13 bp, C. elegans
ttgaagccagaaa

SEQ ID NO: 737109 - DNA, 13 bp, C. elegans
ttgaagcgaaaat

SEQ ID NO: 737110 - DNA, 13 bp, C. elegans
ttgaagcgatttt

SEQ ID NO: 737111 - DNA, 13 bp, C. elegans
ttgaagctaaaaa

SEQ ID NO: 737112 - DNA, 13 bp, C. elegans
ttgaagctctcgg

SEQ ID NO: 737113 - DNA, 13 bp, C. elegans
ttgaagctcttgg

SEQ ID NO: 737114 - DNA, 13 bp, C. elegans
ttgaagctgaagg

SEQ ID NO: 737115 - DNA, 13 bp, C. elegans
ttgaagcttttca

SEQ ID NO: 737116 - DNA, 13 bp, C. elegans
ttgaagctttttg

SEQ ID NO: 737117 - DNA, 13 bp, C. elegans
ttgaaggaaaagt

SEQ ID NO: 737118 - DNA, 13 bp, C. elegans
ttgaaggaattga

SEQ ID NO: 737119 - DNA, 13 bp, C. elegans
ttgaaggtggagt

SEQ ID NO: 737120 - DNA, 13 bp, C. elegans
ttgaaggttttca

SEQ ID NO: 737121 - DNA, 13 bp, C. elegans
ttgaagtaaaata

SEQ ID NO: 737122 - DNA, 13 bp, C. elegans
ttgaagtatattt

SEQ ID NO: 737123 - DNA, 13 bp, C. elegans
ttgaagtattcaa

SEQ ID NO: 737124 - DNA, 13 bp, C. elegans
ttgaagtcaattt

SEQ ID NO: 737125 - DNA, 13 bp, C. elegans
ttgaagtgaaaat

SEQ ID NO: 737126 - DNA, 13 bp, C. elegans
ttgaagtgatatt

SEQ ID NO: 737127 - DNA, 13 bp, C. elegans
ttgaagtggaaaa

SEQ ID NO: 737128 - DNA, 13 bp, C. elegans
ttgaagttgaaaa

SEQ ID NO: 737129 - DNA, 13 bp, C. elegans
ttgaagttgaaga

SEQ ID NO: 737130 - DNA, 13 bp, C. elegans
ttgaagttgttta

SEQ ID NO: 737131 - DNA, 13 bp, C. elegans
ttgaagtttcgaa

SEQ ID NO: 737132 - DNA, 13 bp, C. elegans
ttgaagtttctgg

SEQ ID NO: 737133 - DNA, 13 bp, C. elegans
ttgaagtttgaaa

SEQ ID NO: 737134 - DNA, 13 bp, C. elegans
ttgaagtttgata

SEQ ID NO: 737135 - DNA, 13 bp, C. elegans
ttgaagtttgcaa

SEQ ID NO: 737136 - DNA, 13 bp, C. elegans
ttgaagttttcaa

SEQ ID NO: 737137 - DNA, 13 bp, C. elegans
ttgaagttttcta

SEQ ID NO: 737138 - DNA, 13 bp, C. elegans
ttgaagttttgta

SEQ ID NO: 737139 - DNA, 13 bp, C. elegans
ttgaagtttttct

SEQ ID NO: 737140 - DNA, 13 bp, C. elegans
ttgaagtttttga

SEQ ID NO: 737141 - DNA, 13 bp, C. elegans
ttgaataaaaaac

SEQ ID NO: 737142 - DNA, 13 bp, C. elegans
ttgaataaaaatc

SEQ ID NO: 737143 - DNA, 13 bp, C. elegans
ttgaataaaactt

SEQ ID NO: 737144 - DNA, 13 bp, C. elegans
ttgaataaaagat

SEQ ID NO: 737145 - DNA, 13 bp, C. elegans
ttgaataaaatca

SEQ ID NO: 737146 - DNA, 13 bp, C. elegans
ttgaataaacatt

SEQ ID NO: 737147 - DNA, 13 bp, C. elegans
ttgaataacgaga

SEQ ID NO: 737148 - DNA, 13 bp, C. elegans
ttgaataatcaaa

SEQ ID NO: 737149 - DNA, 13 bp, C. elegans
ttgaataattcag

SEQ ID NO: 737150 - DNA, 13 bp, C. elegans
ttgaataattgaa

SEQ ID NO: 737151 - DNA, 13 bp, C. elegans
ttgaataatttga

SEQ ID NO: 737152 - DNA, 13 bp, C. elegans
ttgaatactacta

SEQ ID NO: 737153 - DNA, 13 bp, C. elegans
ttgaatactttta

SEQ ID NO: 737154 - DNA, 13 bp, C. elegans
ttgaataggaaat

SEQ ID NO: 737155 - DNA, 13 bp, C. elegans
ttgaatagtattt

SEQ ID NO: 737156 - DNA, 13 bp, C. elegans
ttgaatagtttta

SEQ ID NO: 737157 - DNA, 13 bp, C. elegans
ttgaatataaaca

SEQ ID NO: 737158 - DNA, 13 bp, C. elegans
ttgaatatatcaa

SEQ ID NO: 737159 - DNA, 13 bp, C. elegans
ttgaatatatttc

SEQ ID NO: 737160 - DNA, 13 bp, C. elegans
ttgaatatgaaga

SEQ ID NO: 737161 - DNA, 13 bp, C. elegans
ttgaatatgaatt

SEQ ID NO: 737162 - DNA, 13 bp, C. elegans
ttgaatatggaaa

SEQ ID NO: 737163 - DNA, 13 bp, C. elegans
ttgaatattattc

SEQ ID NO: 737164 - DNA, 13 bp, C. elegans
ttgaatattcaga

SEQ ID NO: 737165 - DNA, 13 bp, C. elegans
ttgaatattccaa

SEQ ID NO: 737166 - DNA, 13 bp, C. elegans
ttgaatattctga

SEQ ID NO: 737167 - DNA, 13 bp, C. elegans
ttgaatattggaa

SEQ ID NO: 737168 - DNA, 13 bp, C. elegans
ttgaatattggca

SEQ ID NO: 737169 - DNA, 13 bp, C. elegans
ttgaatatttcaa

SEQ ID NO: 737170 - DNA, 13 bp, C. elegans
ttgaatatttcac

SEQ ID NO: 737171 - DNA, 13 bp, C. elegans
ttgaatatttctt

SEQ ID NO: 737172 - DNA, 13 bp, C. elegans
ttgaatatttgaa

SEQ ID NO: 737173 - DNA, 13 bp, C. elegans
ttgaatattttct

SEQ ID NO: 737174 - DNA, 13 bp, C. elegans
ttgaatcaaaaaa

SEQ ID NO: 737175 - DNA, 13 bp, C. elegans
ttgaatcaaaact

SEQ ID NO: 737176 - DNA, 13 bp, C. elegans
ttgaatcaaaatc

SEQ ID NO: 737177 - DNA, 13 bp, C. elegans
ttgaatcaaaatt

SEQ ID NO: 737178 - DNA, 13 bp, C. elegans
ttgaatcaatgaa

SEQ ID NO: 737179 - DNA, 13 bp, C. elegans
ttgaatcactttt

SEQ ID NO: 737180 - DNA, 13 bp, C. elegans
ttgaatcagtttt

SEQ ID NO: 737181 - DNA, 13 bp, C. elegans
ttgaatcattcaa

SEQ ID NO: 737182 - DNA, 13 bp, C. elegans
ttgaatcattttc

SEQ ID NO: 737183 - DNA, 13 bp, C. elegans
ttgaatctcaaaa

SEQ ID NO: 737184 - DNA, 13 bp, C. elegans
ttgaatctcaaat

SEQ ID NO: 737185 - DNA, 13 bp, C. elegans
ttgaatctggaaa

SEQ ID NO: 737186 - DNA, 13 bp, C. elegans
ttgaatcttttga

SEQ ID NO: 737187 - DNA, 13 bp, C. elegans
ttgaatgaaaaat

SEQ ID NO: 737188 - DNA, 13 bp, C. elegans
ttgaatgaaaagt

SEQ ID NO: 737189 - DNA, 13 bp, C. elegans
ttgaatgaaatta

SEQ ID NO: 737190 - DNA, 13 bp, C. elegans
ttgaatgaagttt

SEQ ID NO: 737191 - DNA, 13 bp, C. elegans
ttgaatgaatgaa

SEQ ID NO: 737192 - DNA, 13 bp, C. elegans
ttgaatgagattt

SEQ ID NO: 737193 - DNA, 13 bp, C. elegans
ttgaatgagtttt

SEQ ID NO: 737194 - DNA, 13 bp, C. elegans
ttgaatgattata

SEQ ID NO: 737195 - DNA, 13 bp, C. elegans
ttgaatgattttc

SEQ ID NO: 737196 - DNA, 13 bp, C. elegans
ttgaatgcaaaac

SEQ ID NO: 737197 - DNA, 13 bp, C. elegans
ttgaatggaattt

SEQ ID NO: 737198 - DNA, 13 bp, C. elegans
ttgaatgtttcaa

SEQ ID NO: 737199 - DNA, 13 bp, C. elegans
ttgaatgtttgaa

SEQ ID NO: 737200 - DNA, 13 bp, C. elegans
ttgaatgttttaa

SEQ ID NO: 737201 - DNA, 13 bp, C. elegans
ttgaattaacttt

SEQ ID NO: 737202 - DNA, 13 bp, C. elegans
ttgaattaagaaa

SEQ ID NO: 737203 - DNA, 13 bp, C. elegans
ttgaattaattca

SEQ ID NO: 737204 - DNA, 13 bp, C. elegans
ttgaattatcata

SEQ ID NO: 737205 - DNA, 13 bp, C. elegans
ttgaattatcatc

SEQ ID NO: 737206 - DNA, 13 bp, C. elegans
ttgaattatcatt

SEQ ID NO: 737207 - DNA, 13 bp, C. elegans
ttgaattatgtat

SEQ ID NO: 737208 - DNA, 13 bp, C. elegans
ttgaattattttc

SEQ ID NO: 737209 - DNA, 13 bp, C. elegans
ttgaattcaaaat

SEQ ID NO: 737210 - DNA, 13 bp, C. elegans
ttgaattcagaaa

SEQ ID NO: 737211 - DNA, 13 bp, C. elegans
ttgaattcagcac

SEQ ID NO: 737212 - DNA, 13 bp, C. elegans
ttgaattcatatt

SEQ ID NO: 737213 - DNA, 13 bp, C. elegans
ttgaattcatttt

SEQ ID NO: 737214 - DNA, 13 bp, C. elegans
ttgaattcccgtt

SEQ ID NO: 737215 - DNA, 13 bp, C. elegans
ttgaattccctcc

SEQ ID NO: 737216 - DNA, 13 bp, C. elegans
ttgaattctaaaa

SEQ ID NO: 737217 - DNA, 13 bp, C. elegans
ttgaattctaatt

SEQ ID NO: 737218 - DNA, 13 bp, C. elegans
ttgaattctccac

SEQ ID NO: 737219 - DNA, 13 bp, C. elegans
ttgaattctcgcc

SEQ ID NO: 737220 - DNA, 13 bp, C. elegans
ttgaattcttatt

SEQ ID NO: 737221 - DNA, 13 bp, C. elegans
ttgaattgaaaat

SEQ ID NO: 737222 - DNA, 13 bp, C. elegans
ttgaattgaatca

SEQ ID NO: 737223 - DNA, 13 bp, C. elegans
ttgaattgaattc

SEQ ID NO: 737224 - DNA, 13 bp, C. elegans
ttgaattgaattt

SEQ ID NO: 737225 - DNA, 13 bp, C. elegans
ttgaattgatttc

SEQ ID NO: 737226 - DNA, 13 bp, C. elegans
ttgaattggaaaa

SEQ ID NO: 737227 - DNA, 13 bp, C. elegans
ttgaattgttttc

SEQ ID NO: 737228 - DNA, 13 bp, C. elegans
ttgaatttcaaaa

SEQ ID NO: 737229 - DNA, 13 bp, C. elegans
ttgaatttcatta

SEQ ID NO: 737230 - DNA, 13 bp, C. elegans
ttgaatttcattg

SEQ ID NO: 737231 - DNA, 13 bp, C. elegans
ttgaatttccaaa

SEQ ID NO: 737232 - DNA, 13 bp, C. elegans
ttgaatttccaat

SEQ ID NO: 737233 - DNA, 13 bp, C. elegans
ttgaatttcccaa

SEQ ID NO: 737234 - DNA, 13 bp, C. elegans
ttgaatttcccac

SEQ ID NO: 737235 - DNA, 13 bp, C. elegans
ttgaatttcccat

SEQ ID NO: 737236 - DNA, 14 bp, C. elegans
ttgaatttcccgcg

SEQ ID NO: 737237 - DNA, 13 bp, C. elegans
ttgaatttccgcc

SEQ ID NO: 737238 - DNA, 13 bp, C. elegans
ttgaatttcctgc

SEQ ID NO: 737239 - DNA, 13 bp, C. elegans
ttgaatttccttc

SEQ ID NO: 737240 - DNA, 13 bp, C. elegans
ttgaatttctcaa

SEQ ID NO: 737241 - DNA, 13 bp, C. elegans
ttgaatttctgtg

SEQ ID NO: 737242 - DNA, 13 bp, C. elegans
ttgaatttcttga

SEQ ID NO: 737243 - DNA, 13 bp, C. elegans
ttgaatttgaaac

SEQ ID NO: 737244 - DNA, 13 bp, C. elegans
ttgaatttgaaat

SEQ ID NO: 737245 - DNA, 13 bp, C. elegans
ttgaatttgagaa

SEQ ID NO: 737246 - DNA, 13 bp, C. elegans
ttgaatttgatga

SEQ ID NO: 737247 - DNA, 13 bp, C. elegans
ttgaatttggaaa

SEQ ID NO: 737248 - DNA, 13 bp, C. elegans
ttgaatttggtaa

SEQ ID NO: 737249 - DNA, 13 bp, C. elegans
ttgaatttgtgaa

SEQ ID NO: 737250 - DNA, 13 bp, C. elegans
ttgaatttgttcg

SEQ ID NO: 737251 - DNA, 13 bp, C. elegans
ttgaatttgttct

SEQ ID NO: 737252 - DNA, 13 bp, C. elegans
ttgaattttcaaa

SEQ ID NO: 737253 - DNA, 13 bp, C. elegans
ttgaattttccag

SEQ ID NO: 737254 - DNA, 13 bp, C. elegans
ttgaattttccga

SEQ ID NO: 737255 - DNA, 13 bp, C. elegans
ttgaattttcgaa

SEQ ID NO: 737256 - DNA, 13 bp, C. elegans
ttgaattttcgac

SEQ ID NO: 737257 - DNA, 13 bp, C. elegans
ttgaattttcgca

SEQ ID NO: 737258 - DNA, 13 bp, C. elegans
ttgaattttgaaa

SEQ ID NO: 737259 - DNA, 13 bp, C. elegans
ttgaattttgaag

SEQ ID NO: 737260 - DNA, 14 bp, C. elegans
ttgaattttgaatt

SEQ ID NO: 737261 - DNA, 13 bp, C. elegans
ttgaattttgtaa

SEQ ID NO: 737262 - DNA, 13 bp, C. elegans
ttgaatttttaca

SEQ ID NO: 737263 - DNA, 13 bp, C. elegans
ttgaatttttcat

SEQ ID NO: 737264 - DNA, 13 bp, C. elegans
ttgaatttttcca

SEQ ID NO: 737265 - DNA, 13 bp, C. elegans
ttgaatttttcta

SEQ ID NO: 737266 - DNA, 13 bp, C. elegans
ttgaatttttgag

SEQ ID NO: 737267 - DNA, 13 bp, C. elegans
ttgaatttttgca

SEQ ID NO: 737268 - DNA, 13 bp, C. elegans
ttgaattttttca

SEQ ID NO: 737269 - DNA, 13 bp, C. elegans
ttgacaaaaacta

SEQ ID NO: 737270 - DNA, 13 bp, C. elegans
ttgacaaaaactt

SEQ ID NO: 737271 - DNA, 13 bp, C. elegans
ttgacaaagaaat

SEQ ID NO: 737272 - DNA, 14 bp, C. elegans
ttgacaaagctcaa

SEQ ID NO: 737273 - DNA, 13 bp, C. elegans
ttgacaaagttat

SEQ ID NO: 737274 - DNA, 13 bp, C. elegans
ttgacaaagtttt

SEQ ID NO: 737275 - DNA, 13 bp, C. elegans
ttgacaaatattt

SEQ ID NO: 737276 - DNA, 13 bp, C. elegans
ttgacaaatttaa

SEQ ID NO: 737277 - DNA, 13 bp, C. elegans
ttgacaaatttct

SEQ ID NO: 737278 - DNA, 13 bp, C. elegans
ttgacaactttca

SEQ ID NO: 737279 - DNA, 13 bp, C. elegans
ttgacaacttttt

SEQ ID NO: 737280 - DNA, 13 bp, C. elegans
ttgacaagaaaag

SEQ ID NO: 737281 - DNA, 13 bp, C. elegans
ttgacaagaaatt

SEQ ID NO: 737282 - DNA, 13 bp, C. elegans
ttgacaagaattt

SEQ ID NO: 737283 - DNA, 13 bp, C. elegans
ttgacaagtcggt

SEQ ID NO: 737284 - DNA, 13 bp, C. elegans
ttgacaagttttt

SEQ ID NO: 737285 - DNA, 13 bp, C. elegans
ttgacaataaata

SEQ ID NO: 737286 - DNA, 13 bp, C. elegans
ttgacaattgtca

SEQ ID NO: 737287 - DNA, 13 bp, C. elegans
ttgacaatttctc

SEQ ID NO: 737288 - DNA, 13 bp, C. elegans
ttgacaatttgac

SEQ ID NO: 737289 - DNA, 13 bp, C. elegans
ttgacacacaaat

SEQ ID NO: 737290 - DNA, 13 bp, C. elegans
ttgacaccacgtg

SEQ ID NO: 737291 - DNA, 13 bp, C. elegans
ttgacacttttct

SEQ ID NO: 737292 - DNA, 13 bp, C. elegans
ttgacactttttg

SEQ ID NO: 737293 - DNA, 13 bp, C. elegans
ttgacagaaaata

SEQ ID NO: 737294 - DNA, 13 bp, C. elegans
ttgacagatgaaa

SEQ ID NO: 737295 - DNA, 13 bp, C. elegans
ttgacagattttt

SEQ ID NO: 737296 - DNA, 13 bp, C. elegans
ttgacagcatttt

SEQ ID NO: 737297 - DNA, 13 bp, C. elegans
ttgacagtttttt

SEQ ID NO: 737298 - DNA, 13 bp, C. elegans
ttgacattttaaa

SEQ ID NO: 737299 - DNA, 13 bp, C. elegans
ttgacattttcca

SEQ ID NO: 737300 - DNA, 13 bp, C. elegans
ttgacattttgaa

SEQ ID NO: 737301 - DNA, 13 bp, C. elegans
ttgacatttttgt

SEQ ID NO: 737302 - DNA, 13 bp, C. elegans
ttgaccaaaactg

SEQ ID NO: 737303 - DNA, 13 bp, C. elegans
ttgaccaaatttt

SEQ ID NO: 737304 - DNA, 13 bp, C. elegans
ttgaccaactttc

SEQ ID NO: 737305 - DNA, 13 bp, C. elegans
ttgaccactttcc

SEQ ID NO: 737306 - DNA, 13 bp, C. elegans
ttgacctagaatt

SEQ ID NO: 737307 - DNA, 13 bp, C. elegans
ttgacgaaaaaat

SEQ ID NO: 737308 - DNA, 13 bp, C. elegans
ttgacgaaaatga

SEQ ID NO: 737309 - DNA, 13 bp, C. elegans
ttgacgaaatttt

SEQ ID NO: 737310 - DNA, 13 bp, C. elegans
ttgacgacttttt

SEQ ID NO: 737311 - DNA, 13 bp, C. elegans
ttgacgattttcc

SEQ ID NO: 737312 - DNA, 13 bp, C. elegans
ttgacgcattttc

SEQ ID NO: 737313 - DNA, 13 bp, C. elegans
ttgactaccgtag

SEQ ID NO: 737314 - DNA, 13 bp, C. elegans
ttgactactggat

SEQ ID NO: 737315 - DNA, 13 bp, C. elegans
ttgactacttttt

SEQ ID NO: 737316 - DNA, 13 bp, C. elegans
ttgactcaatttc

SEQ ID NO: 737317 - DNA, 13 bp, C. elegans
ttgactcaatttt

SEQ ID NO: 737318 - DNA, 13 bp, C. elegans
ttgactctgaaaa

SEQ ID NO: 737319 - DNA, 13 bp, C. elegans
ttgactgaaaaac

SEQ ID NO: 737320 - DNA, 13 bp, C. elegans
ttgactgaaaaca

SEQ ID NO: 737321 - DNA, 13 bp, C. elegans
ttgactgaaaact

SEQ ID NO: 737322 - DNA, 13 bp, C. elegans
ttgactgaaaatt

SEQ ID NO: 737323 - DNA, 13 bp, C. elegans
ttgactgtttcaa

SEQ ID NO: 737324 - DNA, 13 bp, C. elegans
ttgactgttttat

SEQ ID NO: 737325 - DNA, 13 bp, C. elegans
ttgacttcaaaaa

SEQ ID NO: 737326 - DNA, 13 bp, C. elegans
ttgacttgatttt

SEQ ID NO: 737327 - DNA, 13 bp, C. elegans
ttgacttttagaa

SEQ ID NO: 737328 - DNA, 13 bp, C. elegans
ttgactttttcac

SEQ ID NO: 737329 - DNA, 13 bp, C. elegans
ttgactttttgta

SEQ ID NO: 737330 - DNA, 13 bp, C. elegans
ttgagaaaaaatg

SEQ ID NO: 737331 - DNA, 13 bp, C. elegans
ttgagaaaaaatt

SEQ ID NO: 737332 - DNA, 13 bp, C. elegans
ttgagaaaaacaa

SEQ ID NO: 737333 - DNA, 13 bp, C. elegans
ttgagaaaacaca

SEQ ID NO: 737334 - DNA, 13 bp, C. elegans
ttgagaaaaccat

SEQ ID NO: 737335 - DNA, 13 bp, C. elegans
ttgagaaaagaga

SEQ ID NO: 737336 - DNA, 13 bp, C. elegans
ttgagaaaataag

SEQ ID NO: 737337 - DNA, 13 bp, C. elegans
ttgagaaaatatc

SEQ ID NO: 737338 - DNA, 13 bp, C. elegans
ttgagaaaatcca

SEQ ID NO: 737339 - DNA, 13 bp, C. elegans
ttgagaaaatgca

SEQ ID NO: 737340 - DNA, 13 bp, C. elegans
ttgagaaaatgtt

SEQ ID NO: 737341 - DNA, 13 bp, C. elegans
ttgagaaaattat

SEQ ID NO: 737342 - DNA, 13 bp, C. elegans
ttgagaaaattgg

SEQ ID NO: 737343 - DNA, 13 bp, C. elegans
ttgagaaaattgt

SEQ ID NO: 737344 - DNA, 13 bp, C. elegans
ttgagaaacaaaa

SEQ ID NO: 737345 - DNA, 13 bp, C. elegans
ttgagaaacaatt

SEQ ID NO: 737346 - DNA, 13 bp, C. elegans
ttgagaaagaaat

SEQ ID NO: 737347 - DNA, 13 bp, C. elegans
ttgagaaagagaa

SEQ ID NO: 737348 - DNA, 13 bp, C. elegans
ttgagaaataatt

SEQ ID NO: 737349 - DNA, 13 bp, C. elegans
ttgagaaatagaa

SEQ ID NO: 737350 - DNA, 13 bp, C. elegans
ttgagaaatattc

SEQ ID NO: 737351 - DNA, 13 bp, C. elegans
ttgagaaatggaa

SEQ ID NO: 737352 - DNA, 13 bp, C. elegans
ttgagaaatgttc

SEQ ID NO: 737353 - DNA, 13 bp, C. elegans
ttgagaaattaaa

SEQ ID NO: 737354 - DNA, 13 bp, C. elegans
ttgagaaattaca

SEQ ID NO: 737355 - DNA, 13 bp, C. elegans
ttgagaaattcat

SEQ ID NO: 737356 - DNA, 13 bp, C. elegans
ttgagaaatttca

SEQ ID NO: 737357 - DNA, 13 bp, C. elegans
ttgagaactcttt

SEQ ID NO: 737358 - DNA, 13 bp, C. elegans
ttgagaacttaaa

SEQ ID NO: 737359 - DNA, 13 bp, C. elegans
ttgagaagaacaa

SEQ ID NO: 737360 - DNA, 13 bp, C. elegans
ttgagaagaagag

SEQ ID NO: 737361 - DNA, 13 bp, C. elegans
ttgagaagagaaa

SEQ ID NO: 737362 - DNA, 13 bp, C. elegans
ttgagaagcatca

SEQ ID NO: 737363 - DNA, 13 bp, C. elegans
ttgagaagttgaa

SEQ ID NO: 737364 - DNA, 13 bp, C. elegans
ttgagaatattat

SEQ ID NO: 737365 - DNA, 13 bp, C. elegans
ttgagaatatttt

SEQ ID NO: 737366 - DNA, 13 bp, C. elegans
ttgagaatcaaaa

SEQ ID NO: 737367 - DNA, 13 bp, C. elegans
ttgagaatggaaa

SEQ ID NO: 737368 - DNA, 13 bp, C. elegans
ttgagaattattt

SEQ ID NO: 737369 - DNA, 13 bp, C. elegans
ttgagaattcaat

SEQ ID NO: 737370 - DNA, 14 bp, C. elegans
ttgagaattcacgt

SEQ ID NO: 737371 - DNA, 13 bp, C. elegans
ttgagaattggaa

SEQ ID NO: 737372 - DNA, 13 bp, C. elegans
ttgagaatttata

SEQ ID NO: 737373 - DNA, 13 bp, C. elegans
ttgagaatttgga

SEQ ID NO: 737374 - DNA, 13 bp, C. elegans
ttgagaatttgtt

SEQ ID NO: 737375 - DNA, 13 bp, C. elegans
ttgagacaaatta

SEQ ID NO: 737376 - DNA, 13 bp, C. elegans
ttgagacaacttt

SEQ ID NO: 737377 - DNA, 13 bp, C. elegans
ttgagacattttc

SEQ ID NO: 737378 - DNA, 13 bp, C. elegans
ttgagactatttt

SEQ ID NO: 737379 - DNA, 13 bp, C. elegans
ttgagagaaaaat

SEQ ID NO: 737380 - DNA, 13 bp, C. elegans
ttgagagaaatgt

SEQ ID NO: 737381 - DNA, 13 bp, C. elegans
ttgagagaataaa

SEQ ID NO: 737382 - DNA, 13 bp, C. elegans
ttgagagagagag

SEQ ID NO: 737383 - DNA, 13 bp, C. elegans
ttgagatcaattt

SEQ ID NO: 737384 - DNA, 13 bp, C. elegans
ttgagattctttt

SEQ ID NO: 737385 - DNA, 13 bp, C. elegans
ttgagattttaaa

SEQ ID NO: 737386 - DNA, 13 bp, C. elegans
ttgagattttcaa

SEQ ID NO: 737387 - DNA, 13 bp, C. elegans
ttgagattttctg

SEQ ID NO: 737388 - DNA, 13 bp, C. elegans
ttgagattttgat

SEQ ID NO: 737389 - DNA, 13 bp, C. elegans
ttgagattttttc

SEQ ID NO: 737390 - DNA, 13 bp, C. elegans
ttgagcaaaaaag

SEQ ID NO: 737391 - DNA, 13 bp, C. elegans
ttgagcaaaaagt

SEQ ID NO: 737392 - DNA, 13 bp, C. elegans
ttgagcaaaaatt

SEQ ID NO: 737393 - DNA, 13 bp, C. elegans
ttgagcaaaagtt

SEQ ID NO: 737394 - DNA, 13 bp, C. elegans
ttgagcaaaatgg

SEQ ID NO: 737395 - DNA, 13 bp, C. elegans
ttgagcaacatat

SEQ ID NO: 737396 - DNA, 13 bp, C. elegans
ttgagcaacattt

SEQ ID NO: 737397 - DNA, 13 bp, C. elegans
ttgagcaagtttt

SEQ ID NO: 737398 - DNA, 13 bp, C. elegans
ttgagcaataaaa

SEQ ID NO: 737399 - DNA, 13 bp, C. elegans
ttgagcaatttct

SEQ ID NO: 737400 - DNA, 13 bp, C. elegans
ttgagcaatttgt

SEQ ID NO: 737401 - DNA, 13 bp, C. elegans
ttgagcacattca

SEQ ID NO: 737402 - DNA, 13 bp, C. elegans
ttgagcacattga

SEQ ID NO: 737403 - DNA, 13 bp, C. elegans
ttgagcaggaaat

SEQ ID NO: 737404 - DNA, 13 bp, C. elegans
ttgagcatgaaaa

SEQ ID NO: 737405 - DNA, 13 bp, C. elegans
ttgagcattcaaa

SEQ ID NO: 737406 - DNA, 13 bp, C. elegans
ttgagcattttca

SEQ ID NO: 737407 - DNA, 13 bp, C. elegans
ttgagcattttcc

SEQ ID NO: 737408 - DNA, 13 bp, C. elegans
ttgagccaaaaaa

SEQ ID NO: 737409 - DNA, 13 bp, C. elegans
ttgagccaaaact

SEQ ID NO: 737410 - DNA, 13 bp, C. elegans
ttgagcggttttt

SEQ ID NO: 737411 - DNA, 13 bp, C. elegans
ttgagctattttc

SEQ ID NO: 737412 - DNA, 13 bp, C. elegans
ttgagctgaaaac

SEQ ID NO: 737413 - DNA, 13 bp, C. elegans
ttgagctgaaatt

SEQ ID NO: 737414 - DNA, 13 bp, C. elegans
ttgagcttgaaaa

SEQ ID NO: 737415 - DNA, 13 bp, C. elegans
ttgagcttttgaa

SEQ ID NO: 737416 - DNA, 13 bp, C. elegans
ttgagcttttttc

SEQ ID NO: 737417 - DNA, 13 bp, C. elegans
ttgagcttttttg

SEQ ID NO: 737418 - DNA, 13 bp, C. elegans
ttgaggaaaaaac

SEQ ID NO: 737419 - DNA, 13 bp, C. elegans
ttgaggaaaaagt

SEQ ID NO: 737420 - DNA, 13 bp, C. elegans
ttgaggaaatcca

SEQ ID NO: 737421 - DNA, 13 bp, C. elegans
ttgaggagaaaaa

SEQ ID NO: 737422 - DNA, 13 bp, C. elegans
ttgaggagaaaat

SEQ ID NO: 737423 - DNA, 13 bp, C. elegans
ttgagtctaaaaa

SEQ ID NO: 737424 - DNA, 13 bp, C. elegans
ttgagtgaaaatg

SEQ ID NO: 737425 - DNA, 13 bp, C. elegans
ttgagtgaatttt

SEQ ID NO: 737426 - DNA, 13 bp, C. elegans
ttgagttcaaaaa

SEQ ID NO: 737427 - DNA, 13 bp, C. elegans
ttgagttccgccg

SEQ ID NO: 737428 - DNA, 13 bp, C. elegans
ttgagttgattgt

SEQ ID NO: 737429 - DNA, 13 bp, C. elegans
ttgagttgttcaa

SEQ ID NO: 737430 - DNA, 13 bp, C. elegans
ttgagttttcaat

SEQ ID NO: 737431 - DNA, 13 bp, C. elegans
ttgagttttcgag

SEQ ID NO: 737432 - DNA, 13 bp, C. elegans
ttgagttttctga

SEQ ID NO: 737433 - DNA, 13 bp, C. elegans
ttgagtttttgcc

SEQ ID NO: 737434 - DNA, 13 bp, C. elegans
ttgagttttttcg

SEQ ID NO: 737435 - DNA, 13 bp, C. elegans
ttgataaaaaacg

SEQ ID NO: 737436 - DNA, 13 bp, C. elegans
ttgataaaaacca

SEQ ID NO: 737437 - DNA, 13 bp, C. elegans
ttgataaacattt

SEQ ID NO: 737438 - DNA, 13 bp, C. elegans
ttgataaaccaaa

SEQ ID NO: 737439 - DNA, 13 bp, C. elegans
ttgataaagtttt

SEQ ID NO: 737440 - DNA, 13 bp, C. elegans
ttgataaatcatt

SEQ ID NO: 737441 - DNA, 13 bp, C. elegans
ttgataaattcat

SEQ ID NO: 737442 - DNA, 13 bp, C. elegans
ttgataaattgtt

SEQ ID NO: 737443 - DNA, 13 bp, C. elegans
ttgataacatttt

SEQ ID NO: 737444 - DNA, 13 bp, C. elegans
ttgataacttttt

SEQ ID NO: 737445 - DNA, 13 bp, C. elegans
ttgataagaaaat

SEQ ID NO: 737446 - DNA, 13 bp, C. elegans
ttgataagaaatt

SEQ ID NO: 737447 - DNA, 13 bp, C. elegans
ttgataagaagtt

SEQ ID NO: 737448 - DNA, 13 bp, C. elegans
ttgataatgaaaa

SEQ ID NO: 737449 - DNA, 13 bp, C. elegans
ttgataattcaaa

SEQ ID NO: 737450 - DNA, 13 bp, C. elegans
ttgataatttaca

SEQ ID NO: 737451 - DNA, 13 bp, C. elegans
ttgataatttatg

SEQ ID NO: 737452 - DNA, 13 bp, C. elegans
ttgataatttccg

SEQ ID NO: 737453 - DNA, 13 bp, C. elegans
ttgataatttctg

SEQ ID NO: 737454 - DNA, 13 bp, C. elegans
ttgataatttgaa

SEQ ID NO: 737455 - DNA, 13 bp, C. elegans
ttgataatttgta

SEQ ID NO: 737456 - DNA, 13 bp, C. elegans
ttgatactttgat

SEQ ID NO: 737457 - DNA, 13 bp, C. elegans
ttgatacttttca

SEQ ID NO: 737458 - DNA, 13 bp, C. elegans
ttgatacttttta

SEQ ID NO: 737459 - DNA, 13 bp, C. elegans
ttgatactttttg

SEQ ID NO: 737460 - DNA, 13 bp, C. elegans
ttgatagaaaaat

SEQ ID NO: 737461 - DNA, 13 bp, C. elegans
ttgatagaaatga

SEQ ID NO: 737462 - DNA, 13 bp, C. elegans
ttgatagcttttt

SEQ ID NO: 737463 - DNA, 13 bp, C. elegans
ttgatagttttaa

SEQ ID NO: 737464 - DNA, 13 bp, C. elegans
ttgatatacattt

SEQ ID NO: 737465 - DNA, 13 bp, C. elegans
ttgatatatgaaa

SEQ ID NO: 737466 - DNA, 13 bp, C. elegans
ttgatatatttga

SEQ ID NO: 737467 - DNA, 13 bp, C. elegans
ttgatatcttcaa

SEQ ID NO: 737468 - DNA, 13 bp, C. elegans
ttgatatgaaaat

SEQ ID NO: 737469 - DNA, 13 bp, C. elegans
ttgatatgttcaa

SEQ ID NO: 737470 - DNA, 13 bp, C. elegans
ttgatattcaaaa

SEQ ID NO: 737471 - DNA, 13 bp, C. elegans
ttgatattcagaa

SEQ ID NO: 737472 - DNA, 13 bp, C. elegans
ttgatattccaaa

SEQ ID NO: 737473 - DNA, 13 bp, C. elegans
ttgatattcgaaa

SEQ ID NO: 737474 - DNA, 13 bp, C. elegans
ttgatattcggaa

SEQ ID NO: 737475 - DNA, 13 bp, C. elegans
ttgatatttcaaa

SEQ ID NO: 737476 - DNA, 13 bp, C. elegans
ttgatatttctta

SEQ ID NO: 737477 - DNA, 13 bp, C. elegans
ttgatattttcat

SEQ ID NO: 737478 - DNA, 13 bp, C. elegans
ttgatattttgaa

SEQ ID NO: 737479 - DNA, 13 bp, C. elegans
ttgatatttttgc

SEQ ID NO: 737480 - DNA, 13 bp, C. elegans
ttgatcaaaaact

SEQ ID NO: 737481 - DNA, 13 bp, C. elegans
ttgatcaaaatat

SEQ ID NO: 737482 - DNA, 13 bp, C. elegans
ttgatcaaaatta

SEQ ID NO: 737483 - DNA, 13 bp, C. elegans
ttgatcaaaattg

SEQ ID NO: 737484 - DNA, 13 bp, C. elegans
ttgatcaaatttg

SEQ ID NO: 737485 - DNA, 13 bp, C. elegans
ttgatcaacaaca

SEQ ID NO: 737486 - DNA, 13 bp, C. elegans
ttgatcaattgat

SEQ ID NO: 737487 - DNA, 13 bp, C. elegans
ttgatcacaaaaa

SEQ ID NO: 737488 - DNA, 13 bp, C. elegans
ttgatcacatttt

SEQ ID NO: 737489 - DNA, 13 bp, C. elegans
ttgatcacgattt

SEQ ID NO: 737490 - DNA, 13 bp, C. elegans
ttgatcacttttt

SEQ ID NO: 737491 - DNA, 13 bp, C. elegans
ttgatcagttttt

SEQ ID NO: 737492 - DNA, 13 bp, C. elegans
ttgatcataaaat

SEQ ID NO: 737493 - DNA, 13 bp, C. elegans
ttgatcattcaaa

SEQ ID NO: 737494 - DNA, 13 bp, C. elegans
ttgatcatttaaa

SEQ ID NO: 737495 - DNA, 13 bp, C. elegans
ttgatcatttgat

SEQ ID NO: 737496 - DNA, 13 bp, C. elegans
ttgatcattttct

SEQ ID NO: 737497 - DNA, 13 bp, C. elegans
ttgatcattttgt

SEQ ID NO: 737498 - DNA, 13 bp, C. elegans
ttgatcattttta

SEQ ID NO: 737499 - DNA, 13 bp, C. elegans
ttgatccaaataa

SEQ ID NO: 737500 - DNA, 13 bp, C. elegans
ttgatctacctgt

SEQ ID NO: 737501 - DNA, 13 bp, C. elegans
ttgatctacgaaa

SEQ ID NO: 737502 - DNA, 13 bp, C. elegans
ttgatctacgcag

SEQ ID NO: 737503 - DNA, 13 bp, C. elegans
ttgatctactgaa

SEQ ID NO: 737504 - DNA, 13 bp, C. elegans
ttgatctattttc

SEQ ID NO: 737505 - DNA, 13 bp, C. elegans
ttgatctattttg

SEQ ID NO: 737506 - DNA, 13 bp, C. elegans
ttgatctcaaaaa

SEQ ID NO: 737507 - DNA, 13 bp, C. elegans
ttgatctccaaaa

SEQ ID NO: 737508 - DNA, 13 bp, C. elegans
ttgatctccgaaa

SEQ ID NO: 737509 - DNA, 13 bp, C. elegans
ttgatctgaaaaa

SEQ ID NO: 737510 - DNA, 13 bp, C. elegans
ttgatctgaaatt

SEQ ID NO: 737511 - DNA, 13 bp, C. elegans
ttgatctgaattt

SEQ ID NO: 737512 - DNA, 13 bp, C. elegans
ttgatctgcaaaa

SEQ ID NO: 737513 - DNA, 13 bp, C. elegans
ttgatctttcaaa

SEQ ID NO: 737514 - DNA, 13 bp, C. elegans
ttgatcttttgat

SEQ ID NO: 737515 - DNA, 13 bp, C. elegans
ttgatgaaaaaat

SEQ ID NO: 737516 - DNA, 13 bp, C. elegans
ttgatgaaaaata

SEQ ID NO: 737517 - DNA, 13 bp, C. elegans
ttgatgaaaaatc

SEQ ID NO: 737518 - DNA, 13 bp, C. elegans
ttgatgaaaaatt

SEQ ID NO: 737519 - DNA, 13 bp, C. elegans
ttgatgaaaactc

SEQ ID NO: 737520 - DNA, 13 bp, C. elegans
ttgatgaaaactg

SEQ ID NO: 737521 - DNA, 13 bp, C. elegans
ttgatgaaaattc

SEQ ID NO: 737522 - DNA, 13 bp, C. elegans
ttgatgaaatatt

SEQ ID NO: 737523 - DNA, 13 bp, C. elegans
ttgatgaaatttt

SEQ ID NO: 737524 - DNA, 13 bp, C. elegans
ttgatgaacattt

SEQ ID NO: 737525 - DNA, 13 bp, C. elegans
ttgatgaagaaaa

SEQ ID NO: 737526 - DNA, 13 bp, C. elegans
ttgatgaatattg

SEQ ID NO: 737527 - DNA, 13 bp, C. elegans
ttgatgaatgaaa

SEQ ID NO: 737528 - DNA, 13 bp, C. elegans
ttgatgaattgaa

SEQ ID NO: 737529 - DNA, 13 bp, C. elegans
ttgatgagaaaat

SEQ ID NO: 737530 - DNA, 13 bp, C. elegans
ttgatgataaaaa

SEQ ID NO: 737531 - DNA, 13 bp, C. elegans
ttgatgatgatta

SEQ ID NO: 737532 - DNA, 13 bp, C. elegans
ttgatgattcaaa

SEQ ID NO: 737533 - DNA, 13 bp, C. elegans
ttgatgattttca

SEQ ID NO: 737534 - DNA, 13 bp, C. elegans
ttgatgatttttc

SEQ ID NO: 737535 - DNA, 13 bp, C. elegans
ttgatgcaaaaat

SEQ ID NO: 737536 - DNA, 13 bp, C. elegans
ttgatgccggaaa

SEQ ID NO: 737537 - DNA, 13 bp, C. elegans
ttgatggaaaaag

SEQ ID NO: 737538 - DNA, 13 bp, C. elegans
ttgatggaaaaat

SEQ ID NO: 737539 - DNA, 13 bp, C. elegans
ttgatggaaaatg

SEQ ID NO: 737540 - DNA, 13 bp, C. elegans
ttgatggaaattc

SEQ ID NO: 737541 - DNA, 13 bp, C. elegans
ttgatggaatcaa

SEQ ID NO: 737542 - DNA, 13 bp, C. elegans
ttgatgggaaatt

SEQ ID NO: 737543 - DNA, 13 bp, C. elegans
ttgatgttcaaat

SEQ ID NO: 737544 - DNA, 13 bp, C. elegans
ttgatgttttaaa

SEQ ID NO: 737545 - DNA, 13 bp, C. elegans
ttgattaaaagtt

SEQ ID NO: 737546 - DNA, 13 bp, C. elegans
ttgattaagaaat

SEQ ID NO: 737547 - DNA, 13 bp, C. elegans
ttgattaatgaaa

SEQ ID NO: 737548 - DNA, 14 bp, C. elegans
ttgattacaaggtt

SEQ ID NO: 737549 - DNA, 13 bp, C. elegans
ttgattatcaaaa

SEQ ID NO: 737550 - DNA, 13 bp, C. elegans
ttgattatcgatt

SEQ ID NO: 737551 - DNA, 13 bp, C. elegans
ttgattatttcca

SEQ ID NO: 737552 - DNA, 14 bp, C. elegans
ttgattattttcag

SEQ ID NO: 737553 - DNA, 13 bp, C. elegans
ttgattcaattta

SEQ ID NO: 737554 - DNA, 13 bp, C. elegans
ttgattcattgaa

SEQ ID NO: 737555 - DNA, 13 bp, C. elegans
ttgattcatttct

SEQ ID NO: 737556 - DNA, 13 bp, C. elegans
ttgattccaaaaa

SEQ ID NO: 737557 - DNA, 13 bp, C. elegans
ttgattcccaaaa

SEQ ID NO: 737558 - DNA, 13 bp, C. elegans
ttgattcggaaat

SEQ ID NO: 737559 - DNA, 13 bp, C. elegans
ttgattctaaaaa

SEQ ID NO: 737560 - DNA, 13 bp, C. elegans
ttgattctgattt

SEQ ID NO: 737561 - DNA, 13 bp, C. elegans
ttgattcttcttc

SEQ ID NO: 737562 - DNA, 13 bp, C. elegans
ttgattcttttga

SEQ ID NO: 737563 - DNA, 13 bp, C. elegans
ttgattgaagttt

SEQ ID NO: 737564 - DNA, 13 bp, C. elegans
ttgattgaattga

SEQ ID NO: 737565 - DNA, 13 bp, C. elegans
ttgattgactttt

SEQ ID NO: 737566 - DNA, 13 bp, C. elegans
ttgattgataaat

SEQ ID NO: 737567 - DNA, 13 bp, C. elegans
ttgattgattgat

SEQ ID NO: 737568 - DNA, 13 bp, C. elegans
ttgattgatttca

SEQ ID NO: 737569 - DNA, 13 bp, C. elegans
ttgattgatttga

SEQ ID NO: 737570 - DNA, 13 bp, C. elegans
ttgattgtaaatt

SEQ ID NO: 737571 - DNA, 13 bp, C. elegans
ttgatttaaatac

SEQ ID NO: 737572 - DNA, 13 bp, C. elegans
ttgatttaatcaa

SEQ ID NO: 737573 - DNA, 13 bp, C. elegans
ttgatttaattga

SEQ ID NO: 737574 - DNA, 13 bp, C. elegans
ttgatttatctga

SEQ ID NO: 737575 - DNA, 13 bp, C. elegans
ttgatttcagaaa

SEQ ID NO: 737576 - DNA, 13 bp, C. elegans
ttgatttcataaa

SEQ ID NO: 737577 - DNA, 13 bp, C. elegans
ttgatttcattat

SEQ ID NO: 737578 - DNA, 13 bp, C. elegans
ttgatttccaatt

SEQ ID NO: 737579 - DNA, 13 bp, C. elegans
ttgatttccggca

SEQ ID NO: 737580 - DNA, 13 bp, C. elegans
ttgatttctgata

SEQ ID NO: 737581 - DNA, 13 bp, C. elegans
ttgatttcttcaa

SEQ ID NO: 737582 - DNA, 13 bp, C. elegans
ttgatttcttgac

SEQ ID NO: 737583 - DNA, 13 bp, C. elegans
ttgatttctttaa

SEQ ID NO: 737584 - DNA, 13 bp, C. elegans
ttgatttgaaaaa

SEQ ID NO: 737585 - DNA, 13 bp, C. elegans
ttgatttgaaaca

SEQ ID NO: 737586 - DNA, 13 bp, C. elegans
ttgatttgaagaa

SEQ ID NO: 737587 - DNA, 13 bp, C. elegans
ttgatttgaagtg

SEQ ID NO: 737588 - DNA, 13 bp, C. elegans
ttgatttgagctt

SEQ ID NO: 737589 - DNA, 13 bp, C. elegans
ttgatttggaaaa

SEQ ID NO: 737590 - DNA, 13 bp, C. elegans
ttgatttgtttca

SEQ ID NO: 737591 - DNA, 13 bp, C. elegans
ttgattttacaaa

SEQ ID NO: 737592 - DNA, 13 bp, C. elegans
ttgattttattac

SEQ ID NO: 737593 - DNA, 13 bp, C. elegans
ttgattttcaagc

SEQ ID NO: 737594 - DNA, 13 bp, C. elegans
ttgattttcaata

SEQ ID NO: 737595 - DNA, 13 bp, C. elegans
ttgattttcaatc

SEQ ID NO: 737596 - DNA, 13 bp, C. elegans
ttgattttcacat

SEQ ID NO: 737597 - DNA, 13 bp, C. elegans
ttgattttcagtc

SEQ ID NO: 737598 - DNA, 13 bp, C. elegans
ttgattttcttca

SEQ ID NO: 737599 - DNA, 13 bp, C. elegans
ttgattttgaaag

SEQ ID NO: 737600 - DNA, 13 bp, C. elegans
ttgattttgaaga

SEQ ID NO: 737601 - DNA, 13 bp, C. elegans
ttgattttgacaa

SEQ ID NO: 737602 - DNA, 13 bp, C. elegans
ttgattttgagcc

SEQ ID NO: 737603 - DNA, 13 bp, C. elegans
ttgattttgatca

SEQ ID NO: 737604 - DNA, 13 bp, C. elegans
ttgattttgttca

SEQ ID NO: 737605 - DNA, 13 bp, C. elegans
ttgatttttatca

SEQ ID NO: 737606 - DNA, 13 bp, C. elegans
ttgatttttcaat

SEQ ID NO: 737607 - DNA, 13 bp, C. elegans
ttgatttttcata

SEQ ID NO: 737608 - DNA, 13 bp, C. elegans
ttgatttttcgaa

SEQ ID NO: 737609 - DNA, 13 bp, C. elegans
ttgatttttctgg

SEQ ID NO: 737610 - DNA, 13 bp, C. elegans
ttgatttttgatc

SEQ ID NO: 737611 - DNA, 13 bp, C. elegans
ttgatttttgcat

SEQ ID NO: 737612 - DNA, 13 bp, C. elegans
ttgatttttggaa

SEQ ID NO: 737613 - DNA, 13 bp, C. elegans
ttgattttttagc

SEQ ID NO: 737614 - DNA, 13 bp, C. elegans
ttgattttttcca

SEQ ID NO: 737615 - DNA, 13 bp, C. elegans
ttgattttttcgc

SEQ ID NO: 737616 - DNA, 13 bp, C. elegans
ttgcaaaaaaaat

SEQ ID NO: 737617 - DNA, 13 bp, C. elegans
ttgcaaaaaaatt

SEQ ID NO: 737618 - DNA, 13 bp, C. elegans
ttgcaaaaaagcg

SEQ ID NO: 737619 - DNA, 13 bp, C. elegans
ttgcaaaaaagtg

SEQ ID NO: 737620 - DNA, 13 bp, C. elegans
ttgcaaaaaatct

SEQ ID NO: 737621 - DNA, 13 bp, C. elegans
ttgcaaaaataaa

SEQ ID NO: 737622 - DNA, 13 bp, C. elegans
ttgcaaaaatatt

SEQ ID NO: 737623 - DNA, 13 bp, C. elegans
ttgcaaaaatgct

SEQ ID NO: 737624 - DNA, 13 bp, C. elegans
ttgcaaaaatgtg

SEQ ID NO: 737625 - DNA, 13 bp, C. elegans
ttgcaaaaattaa

SEQ ID NO: 737626 - DNA, 13 bp, C. elegans
ttgcaaaaattgt

SEQ ID NO: 737627 - DNA, 13 bp, C. elegans
ttgcaaaacattt

SEQ ID NO: 737628 - DNA, 13 bp, C. elegans
ttgcaaaaccaaa

SEQ ID NO: 737629 - DNA, 13 bp, C. elegans
ttgcaaaagaaaa

SEQ ID NO: 737630 - DNA, 13 bp, C. elegans
ttgcaaaagtttg

SEQ ID NO: 737631 - DNA, 13 bp, C. elegans
ttgcaaaatatga

SEQ ID NO: 737632 - DNA, 13 bp, C. elegans
ttgcaaaatatgt

SEQ ID NO: 737633 - DNA, 13 bp, C. elegans
ttgcaaaatcgaa

SEQ ID NO: 737634 - DNA, 13 bp, C. elegans
ttgcaaaatctca

SEQ ID NO: 737635 - DNA, 13 bp, C. elegans
ttgcaaaatgaaa

SEQ ID NO: 737636 - DNA, 13 bp, C. elegans
ttgcaaaatgttg

SEQ ID NO: 737637 - DNA, 13 bp, C. elegans
ttgcaaaattacg

SEQ ID NO: 737638 - DNA, 13 bp, C. elegans
ttgcaaaattcat

SEQ ID NO: 737639 - DNA, 13 bp, C. elegans
ttgcaaaattgaa

SEQ ID NO: 737640 - DNA, 13 bp, C. elegans
ttgcaaaatttaa

SEQ ID NO: 737641 - DNA, 13 bp, C. elegans
ttgcaaaatttcg

SEQ ID NO: 737642 - DNA, 13 bp, C. elegans
ttgcaaacaaaat

SEQ ID NO: 737643 - DNA, 13 bp, C. elegans
ttgcaaacttgaa

SEQ ID NO: 737644 - DNA, 13 bp, C. elegans
ttgcaaactttga

SEQ ID NO: 737645 - DNA, 13 bp, C. elegans
ttgcaaacttttc

SEQ ID NO: 737646 - DNA, 13 bp, C. elegans
ttgcaaagaaaaa

SEQ ID NO: 737647 - DNA, 13 bp, C. elegans
ttgcaaagatttt

SEQ ID NO: 737648 - DNA, 13 bp, C. elegans
ttgcaaagtgttt

SEQ ID NO: 737649 - DNA, 13 bp, C. elegans
ttgcaaagtttta

SEQ ID NO: 737650 - DNA, 13 bp, C. elegans
ttgcaaatattat

SEQ ID NO: 737651 - DNA, 13 bp, C. elegans
ttgcaaatatttc

SEQ ID NO: 737652 - DNA, 13 bp, C. elegans
ttgcaaatcaatt

SEQ ID NO: 737653 - DNA, 13 bp, C. elegans
ttgcaaatgattt

SEQ ID NO: 737654 - DNA, 13 bp, C. elegans
ttgcaaatgcgct

SEQ ID NO: 737655 - DNA, 13 bp, C. elegans
ttgcaaattcaaa

SEQ ID NO: 737656 - DNA, 13 bp, C. elegans
ttgcaaattccaa

SEQ ID NO: 737657 - DNA, 13 bp, C. elegans
ttgcaaattctca

SEQ ID NO: 737658 - DNA, 13 bp, C. elegans
ttgcaaattcttc

SEQ ID NO: 737659 - DNA, 13 bp, C. elegans
ttgcaaattgcca

SEQ ID NO: 737660 - DNA, 13 bp, C. elegans
ttgcaaatttaaa

SEQ ID NO: 737661 - DNA, 13 bp, C. elegans
ttgcaaatttgaa

SEQ ID NO: 737662 - DNA, 13 bp, C. elegans
ttgcaacaaaaag

SEQ ID NO: 737663 - DNA, 13 bp, C. elegans
ttgcaacaaaaat

SEQ ID NO: 737664 - DNA, 13 bp, C. elegans
ttgcaacaaaatg

SEQ ID NO: 737665 - DNA, 13 bp, C. elegans
ttgcaacaacaaa

SEQ ID NO: 737666 - DNA, 13 bp, C. elegans
ttgcaacaataaa

SEQ ID NO: 737667 - DNA, 13 bp, C. elegans
ttgcaacaatttt

SEQ ID NO: 737668 - DNA, 13 bp, C. elegans
ttgcaacactttt

SEQ ID NO: 737669 - DNA, 13 bp, C. elegans
ttgcaacagtttt

SEQ ID NO: 737670 - DNA, 13 bp, C. elegans
ttgcaactaaaaa

SEQ ID NO: 737671 - DNA, 13 bp, C. elegans
ttgcaacttctta

SEQ ID NO: 737672 - DNA, 13 bp, C. elegans
ttgcaacttgaaa

SEQ ID NO: 737673 - DNA, 13 bp, C. elegans
ttgcaactttaat

SEQ ID NO: 737674 - DNA, 13 bp, C. elegans
ttgcaacttttgc

SEQ ID NO: 737675 - DNA, 13 bp, C. elegans
ttgcaagaaaatc

SEQ ID NO: 737676 - DNA, 13 bp, C. elegans
ttgcaagcatttt

SEQ ID NO: 737677 - DNA, 13 bp, C. elegans
ttgcaagcttttt

SEQ ID NO: 737678 - DNA, 13 bp, C. elegans
ttgcaataaaatc

SEQ ID NO: 737679 - DNA, 13 bp, C. elegans
ttgcaataataat

SEQ ID NO: 737680 - DNA, 13 bp, C. elegans
ttgcaataatttc

SEQ ID NO: 737681 - DNA, 13 bp, C. elegans
ttgcaataatttt

SEQ ID NO: 737682 - DNA, 13 bp, C. elegans
ttgcaatattaat

SEQ ID NO: 737683 - DNA, 13 bp, C. elegans
ttgcaatcatttt

SEQ ID NO: 737684 - DNA, 13 bp, C. elegans
ttgcaatcttttt

SEQ ID NO: 737685 - DNA, 13 bp, C. elegans
ttgcaatgaaaat

SEQ ID NO: 737686 - DNA, 13 bp, C. elegans
ttgcaatgtttca

SEQ ID NO: 737687 - DNA, 13 bp, C. elegans
ttgcaattcaaaa

SEQ ID NO: 737688 - DNA, 13 bp, C. elegans
ttgcaatttcaat

SEQ ID NO: 737689 - DNA, 13 bp, C. elegans
ttgcaatttgtca

SEQ ID NO: 737690 - DNA, 13 bp, C. elegans
ttgcaattttcat

SEQ ID NO: 737691 - DNA, 13 bp, C. elegans
ttgcaattttcgt

SEQ ID NO: 737692 - DNA, 13 bp, C. elegans
ttgcaattttctc

SEQ ID NO: 737693 - DNA, 13 bp, C. elegans
ttgcaatttttgc

SEQ ID NO: 737694 - DNA, 13 bp, C. elegans
ttgcacaaaaagt

SEQ ID NO: 737695 - DNA, 13 bp, C. elegans
ttgcacaaaaatg

SEQ ID NO: 737696 - DNA, 13 bp, C. elegans
ttgcacaatattt

SEQ ID NO: 737697 - DNA, 13 bp, C. elegans
ttgcacaatttct

SEQ ID NO: 737698 - DNA, 13 bp, C. elegans
ttgcacaatttta

SEQ ID NO: 737699 - DNA, 13 bp, C. elegans
ttgcacaattttg

SEQ ID NO: 737700 - DNA, 13 bp, C. elegans
ttgcacacaattt

SEQ ID NO: 737701 - DNA, 13 bp, C. elegans
ttgcacacatttt

SEQ ID NO: 737702 - DNA, 13 bp, C. elegans
ttgcacaccaaaa

SEQ ID NO: 737703 - DNA, 13 bp, C. elegans
ttgcacataaatt

SEQ ID NO: 737704 - DNA, 13 bp, C. elegans
ttgcacataattt

SEQ ID NO: 737705 - DNA, 13 bp, C. elegans
ttgcacattttca

SEQ ID NO: 737706 - DNA, 13 bp, C. elegans
ttgcacattttga

SEQ ID NO: 737707 - DNA, 13 bp, C. elegans
ttgcacatttttt

SEQ ID NO: 737708 - DNA, 13 bp, C. elegans
ttgcaccaatttt

SEQ ID NO: 737709 - DNA, 13 bp, C. elegans
ttgcacctttttt

SEQ ID NO: 737710 - DNA, 13 bp, C. elegans
ttgcactgaaaat

SEQ ID NO: 737711 - DNA, 13 bp, C. elegans
ttgcactgacaaa

SEQ ID NO: 737712 - DNA, 13 bp, C. elegans
ttgcactgaccaa

SEQ ID NO: 737713 - DNA, 13 bp, C. elegans
ttgcactgaccac

SEQ ID NO: 737714 - DNA, 13 bp, C. elegans
ttgcactggaaaa

SEQ ID NO: 737715 - DNA, 13 bp, C. elegans
ttgcacttttcat

SEQ ID NO: 737716 - DNA, 13 bp, C. elegans
ttgcactttttca

SEQ ID NO: 737717 - DNA, 13 bp, C. elegans
ttgcactttttga

SEQ ID NO: 737718 - DNA, 13 bp, C. elegans
ttgcagaaaaaag

SEQ ID NO: 737719 - DNA, 13 bp, C. elegans
ttgcagaaaaaat

SEQ ID NO: 737720 - DNA, 13 bp, C. elegans
ttgcagaaaaaga

SEQ ID NO: 737721 - DNA, 13 bp, C. elegans
ttgcagaaaaagt

SEQ ID NO: 737722 - DNA, 13 bp, C. elegans
ttgcagaaaatat

SEQ ID NO: 737723 - DNA, 13 bp, C. elegans
ttgcagaattgaa

SEQ ID NO: 737724 - DNA, 13 bp, C. elegans
ttgcagaattttt

SEQ ID NO: 737725 - DNA, 13 bp, C. elegans
ttgcagatttgcc

SEQ ID NO: 737726 - DNA, 13 bp, C. elegans
ttgcagctgaaaa

SEQ ID NO: 737727 - DNA, 13 bp, C. elegans
ttgcaggaaatgt

SEQ ID NO: 737728 - DNA, 13 bp, C. elegans
ttgcaggaagaaa

SEQ ID NO: 737729 - DNA, 13 bp, C. elegans
ttgcagtattttt

SEQ ID NO: 737730 - DNA, 13 bp, C. elegans
ttgcagttatttt

SEQ ID NO: 737731 - DNA, 13 bp, C. elegans
ttgcagtttcaaa

SEQ ID NO: 737732 - DNA, 13 bp, C. elegans
ttgcagttttata

SEQ ID NO: 737733 - DNA, 13 bp, C. elegans
ttgcagttttttc

SEQ ID NO: 737734 - DNA, 13 bp, C. elegans
ttgcataaatatt

SEQ ID NO: 737735 - DNA, 13 bp, C. elegans
ttgcataatttca

SEQ ID NO: 737736 - DNA, 13 bp, C. elegans
ttgcataatttga

SEQ ID NO: 737737 - DNA, 13 bp, C. elegans
ttgcatataaaat

SEQ ID NO: 737738 - DNA, 13 bp, C. elegans
ttgcatattattt

SEQ ID NO: 737739 - DNA, 13 bp, C. elegans
ttgcatatttatt

SEQ ID NO: 737740 - DNA, 13 bp, C. elegans
ttgcatatttgaa

SEQ ID NO: 737741 - DNA, 13 bp, C. elegans
ttgcatatttttc

SEQ ID NO: 737742 - DNA, 13 bp, C. elegans
ttgcatcaaaaat

SEQ ID NO: 737743 - DNA, 13 bp, C. elegans
ttgcatgcaatac

SEQ ID NO: 737744 - DNA, 13 bp, C. elegans
ttgcattaatttt

SEQ ID NO: 737745 - DNA, 13 bp, C. elegans
ttgcattattttc

SEQ ID NO: 737746 - DNA, 13 bp, C. elegans
ttgcattcaaatt

SEQ ID NO: 737747 - DNA, 13 bp, C. elegans
ttgcattcaattt

SEQ ID NO: 737748 - DNA, 13 bp, C. elegans
ttgcattcatttt

SEQ ID NO: 737749 - DNA, 13 bp, C. elegans
ttgcattgaaatt

SEQ ID NO: 737750 - DNA, 13 bp, C. elegans
ttgcattgcaaaa

SEQ ID NO: 737751 - DNA, 13 bp, C. elegans
ttgcattgttttc

SEQ ID NO: 737752 - DNA, 13 bp, C. elegans
ttgcatttaataa

SEQ ID NO: 737753 - DNA, 13 bp, C. elegans
ttgcatttcaaaa

SEQ ID NO: 737754 - DNA, 13 bp, C. elegans
ttgcatttcaatt

SEQ ID NO: 737755 - DNA, 13 bp, C. elegans
ttgcatttgaatt

SEQ ID NO: 737756 - DNA, 13 bp, C. elegans
ttgcattttaaaa

SEQ ID NO: 737757 - DNA, 13 bp, C. elegans
ttgcattttattc

SEQ ID NO: 737758 - DNA, 13 bp, C. elegans
ttgcatttttcaa

SEQ ID NO: 737759 - DNA, 13 bp, C. elegans
ttgcatttttcca

SEQ ID NO: 737760 - DNA, 13 bp, C. elegans
ttgcatttttcct

SEQ ID NO: 737761 - DNA, 13 bp, C. elegans
ttgcatttttcgt

SEQ ID NO: 737762 - DNA, 13 bp, C. elegans
ttgcatttttgct

SEQ ID NO: 737763 - DNA, 13 bp, C. elegans
ttgcatttttgga

SEQ ID NO: 737764 - DNA, 13 bp, C. elegans
ttgcattttttgc

SEQ ID NO: 737765 - DNA, 13 bp, C. elegans
ttgccaaaaaaaa

SEQ ID NO: 737766 - DNA, 13 bp, C. elegans
ttgccaaaaaaac

SEQ ID NO: 737767 - DNA, 13 bp, C. elegans
ttgccaaaaaaag

SEQ ID NO: 737768 - DNA, 13 bp, C. elegans
ttgccaaaaaaga

SEQ ID NO: 737769 - DNA, 13 bp, C. elegans
ttgccaaaaaatt

SEQ ID NO: 737770 - DNA, 13 bp, C. elegans
ttgccaaaaacat

SEQ ID NO: 737771 - DNA, 13 bp, C. elegans
ttgccaaaaatca

SEQ ID NO: 737772 - DNA, 13 bp, C. elegans
ttgccaaaaatcc

SEQ ID NO: 737773 - DNA, 13 bp, C. elegans
ttgccaaaacatt

SEQ ID NO: 737774 - DNA, 13 bp, C. elegans
ttgccaaaacttt

SEQ ID NO: 737775 - DNA, 13 bp, C. elegans
ttgccaaaatcaa

SEQ ID NO: 737776 - DNA, 13 bp, C. elegans
ttgccaaaatgaa

SEQ ID NO: 737777 - DNA, 13 bp, C. elegans
ttgccaaaattaa

SEQ ID NO: 737778 - DNA, 13 bp, C. elegans
ttgccaaaattgt

SEQ ID NO: 737779 - DNA, 13 bp, C. elegans
ttgccaaaatttc

SEQ ID NO: 737780 - DNA, 13 bp, C. elegans
ttgccaaacttct

SEQ ID NO: 737781 - DNA, 13 bp, C. elegans
ttgccaaactttc

SEQ ID NO: 737782 - DNA, 13 bp, C. elegans
ttgccaaatatca

SEQ ID NO: 737783 - DNA, 13 bp, C. elegans
ttgccaaatttat

SEQ ID NO: 737784 - DNA, 13 bp, C. elegans
ttgccaaatttta

SEQ ID NO: 737785 - DNA, 13 bp, C. elegans
ttgccaaattttc

SEQ ID NO: 737786 - DNA, 13 bp, C. elegans
ttgccaaattttt

SEQ ID NO: 737787 - DNA, 13 bp, C. elegans
ttgccaacaaatt

SEQ ID NO: 737788 - DNA, 13 bp, C. elegans
ttgccaacaactt

SEQ ID NO: 737789 - DNA, 13 bp, C. elegans
ttgccaactaata

SEQ ID NO: 737790 - DNA, 13 bp, C. elegans
ttgccaacttctc

SEQ ID NO: 737791 - DNA, 13 bp, C. elegans
ttgccaacttctg

SEQ ID NO: 737792 - DNA, 13 bp, C. elegans
ttgccaacttgcc

SEQ ID NO: 737793 - DNA, 13 bp, C. elegans
ttgccaactttta

SEQ ID NO: 737794 - DNA, 13 bp, C. elegans
ttgccaacttttg

SEQ ID NO: 737795 - DNA, 13 bp, C. elegans
ttgccaagaaaaa

SEQ ID NO: 737796 - DNA, 13 bp, C. elegans
ttgccaagtttgc

SEQ ID NO: 737797 - DNA, 13 bp, C. elegans
ttgccaattattt

SEQ ID NO: 737798 - DNA, 13 bp, C. elegans
ttgccaatttaaa

SEQ ID NO: 737799 - DNA, 13 bp, C. elegans
ttgccaatttcca

SEQ ID NO: 737800 - DNA, 13 bp, C. elegans
ttgccaatttctc

SEQ ID NO: 737801 - DNA, 13 bp, C. elegans
ttgccaatttctg

SEQ ID NO: 737802 - DNA, 13 bp, C. elegans
ttgccaattttcc

SEQ ID NO: 737803 - DNA, 13 bp, C. elegans
ttgccaattttga

SEQ ID NO: 737804 - DNA, 13 bp, C. elegans
ttgccaattttgc

SEQ ID NO: 737805 - DNA, 13 bp, C. elegans
ttgccaatttttg

SEQ ID NO: 737806 - DNA, 13 bp, C. elegans
ttgccacaaaatt

SEQ ID NO: 737807 - DNA, 13 bp, C. elegans
ttgccacaatttt

SEQ ID NO: 737808 - DNA, 13 bp, C. elegans
ttgccacacacac

SEQ ID NO: 737809 - DNA, 13 bp, C. elegans
ttgccacattttt

SEQ ID NO: 737810 - DNA, 13 bp, C. elegans
ttgccacgatgac

SEQ ID NO: 737811 - DNA, 13 bp, C. elegans
ttgccacgtcatc

SEQ ID NO: 737812 - DNA, 13 bp, C. elegans
ttgccacgtcatt

SEQ ID NO: 737813 - DNA, 13 bp, C. elegans
ttgccacgttttt

SEQ ID NO: 737814 - DNA, 13 bp, C. elegans
ttgccagaaaatc

SEQ ID NO: 737815 - DNA, 13 bp, C. elegans
ttgccagaaattt

SEQ ID NO: 737816 - DNA, 13 bp, C. elegans
ttgccagaagttt

SEQ ID NO: 737817 - DNA, 13 bp, C. elegans
ttgccagattttc

SEQ ID NO: 737818 - DNA, 13 bp, C. elegans
ttgccagcaattt

SEQ ID NO: 737819 - DNA, 13 bp, C. elegans
ttgccagttttcc

SEQ ID NO: 737820 - DNA, 13 bp, C. elegans
ttgccataaattt

SEQ ID NO: 737821 - DNA, 13 bp, C. elegans
ttgccatttttcc

SEQ ID NO: 737822 - DNA, 13 bp, C. elegans
ttgccatttttgg

SEQ ID NO: 737823 - DNA, 13 bp, C. elegans
ttgccattttttc

SEQ ID NO: 737824 - DNA, 14 bp, C. elegans
ttgcccaaaaaaaa

SEQ ID NO: 737825 - DNA, 13 bp, C. elegans
ttgcccaaaaaac

SEQ ID NO: 737826 - DNA, 13 bp, C. elegans
ttgcccaaatttc

SEQ ID NO: 737827 - DNA, 13 bp, C. elegans
ttgcccaaatttg

SEQ ID NO: 737828 - DNA, 13 bp, C. elegans
ttgcccaagtttt

SEQ ID NO: 737829 - DNA, 13 bp, C. elegans
ttgcccaatttgt

SEQ ID NO: 737830 - DNA, 13 bp, C. elegans
ttgcccactttca

SEQ ID NO: 737831 - DNA, 13 bp, C. elegans
ttgcccacttttc

SEQ ID NO: 737832 - DNA, 13 bp, C. elegans
ttgcccagaaaaa

SEQ ID NO: 737833 - DNA, 13 bp, C. elegans
ttgcccattttcc

SEQ ID NO: 737834 - DNA, 13 bp, C. elegans
ttgccccaaaaat

SEQ ID NO: 737835 - DNA, 13 bp, C. elegans
ttgcccgtaattt

SEQ ID NO: 737836 - DNA, 13 bp, C. elegans
ttgccctactttt

SEQ ID NO: 737837 - DNA, 13 bp, C. elegans
ttgccgaaaaaaa

SEQ ID NO: 737838 - DNA, 13 bp, C. elegans
ttgccgaaaaaat

SEQ ID NO: 737839 - DNA, 13 bp, C. elegans
ttgccgaaaactt

SEQ ID NO: 737840 - DNA, 13 bp, C. elegans
ttgccgaaaagtt

SEQ ID NO: 737841 - DNA, 13 bp, C. elegans
ttgccgaaaatta

SEQ ID NO: 737842 - DNA, 13 bp, C. elegans
ttgccgaaaattc

SEQ ID NO: 737843 - DNA, 13 bp, C. elegans
ttgccgaaaattt

SEQ ID NO: 737844 - DNA, 13 bp, C. elegans
ttgccgaaacttt

SEQ ID NO: 737845 - DNA, 13 bp, C. elegans
ttgccgaaatttt

SEQ ID NO: 737846 - DNA, 13 bp, C. elegans
ttgccgaacgaca

SEQ ID NO: 737847 - DNA, 13 bp, C. elegans
ttgccgaagttgc

SEQ ID NO: 737848 - DNA, 13 bp, C. elegans
ttgccgaattgtc

SEQ ID NO: 737849 - DNA, 13 bp, C. elegans
ttgccgaatttct

SEQ ID NO: 737850 - DNA, 14 bp, C. elegans
ttgccgagctcgga

SEQ ID NO: 737851 - DNA, 13 bp, C. elegans
ttgccgagttgcc

SEQ ID NO: 737852 - DNA, 13 bp, C. elegans
ttgccgagtttgt

SEQ ID NO: 737853 - DNA, 13 bp, C. elegans
ttgccgattcgcc

SEQ ID NO: 737854 - DNA, 13 bp, C. elegans
ttgccgattgccg

SEQ ID NO: 737855 - DNA, 13 bp, C. elegans
ttgccgatttgcc

SEQ ID NO: 737856 - DNA, 13 bp, C. elegans
ttgccgattttcc

SEQ ID NO: 737857 - DNA, 13 bp, C. elegans
ttgccgatttttc

SEQ ID NO: 737858 - DNA, 13 bp, C. elegans
ttgccgatttttt

SEQ ID NO: 737859 - DNA, 13 bp, C. elegans
ttgccgcccatcc

SEQ ID NO: 737860 - DNA, 13 bp, C. elegans
ttgccgcctaccc

SEQ ID NO: 737861 - DNA, 13 bp, C. elegans
ttgccggaaaact

SEQ ID NO: 737862 - DNA, 13 bp, C. elegans
ttgccggaaatgt

SEQ ID NO: 737863 - DNA, 13 bp, C. elegans
ttgccggaaattc

SEQ ID NO: 737864 - DNA, 13 bp, C. elegans
ttgccggaaattt

SEQ ID NO: 737865 - DNA, 13 bp, C. elegans
ttgccggaagtga

SEQ ID NO: 737866 - DNA, 13 bp, C. elegans
ttgccggaataaa

SEQ ID NO: 737867 - DNA, 13 bp, C. elegans
ttgccggaatcgc

SEQ ID NO: 737868 - DNA, 13 bp, C. elegans
ttgccggaattca

SEQ ID NO: 737869 - DNA, 13 bp, C. elegans
ttgccggaatttt

SEQ ID NO: 737870 - DNA, 13 bp, C. elegans
ttgccggagtttt

SEQ ID NO: 737871 - DNA, 13 bp, C. elegans
ttgccggttgccg

SEQ ID NO: 737872 - DNA, 13 bp, C. elegans
ttgccggtttacc

SEQ ID NO: 737873 - DNA, 13 bp, C. elegans
ttgccggttttcc

SEQ ID NO: 737874 - DNA, 13 bp, C. elegans
ttgccggttttgt

SEQ ID NO: 737875 - DNA, 13 bp, C. elegans
ttgccgtgcttaa

SEQ ID NO: 737876 - DNA, 13 bp, C. elegans
ttgccgttttccg

SEQ ID NO: 737877 - DNA, 13 bp, C. elegans
ttgccgtttttca

SEQ ID NO: 737878 - DNA, 13 bp, C. elegans
ttgccgtttttcc

SEQ ID NO: 737879 - DNA, 13 bp, C. elegans
ttgcctattttta

SEQ ID NO: 737880 - DNA, 13 bp, C. elegans
ttgcctcatttct

SEQ ID NO: 737881 - DNA, 13 bp, C. elegans
ttgcctgaaagtt

SEQ ID NO: 737882 - DNA, 13 bp, C. elegans
ttgcctgaaattt

SEQ ID NO: 737883 - DNA, 13 bp, C. elegans
ttgcgaaaaatac

SEQ ID NO: 737884 - DNA, 13 bp, C. elegans
ttgcgaaaacaat

SEQ ID NO: 737885 - DNA, 14 bp, C. elegans
ttgcgaaaccgatt

SEQ ID NO: 737886 - DNA, 13 bp, C. elegans
ttgcgaaatttcg

SEQ ID NO: 737887 - DNA, 13 bp, C. elegans
ttgcgaataaaaa

SEQ ID NO: 737888 - DNA, 13 bp, C. elegans
ttgcgaatttttt

SEQ ID NO: 737889 - DNA, 13 bp, C. elegans
ttgcgatattttt

SEQ ID NO: 737890 - DNA, 13 bp, C. elegans
ttgcgattttaaa

SEQ ID NO: 737891 - DNA, 13 bp, C. elegans
ttgcgcacacaca

SEQ ID NO: 737892 - DNA, 13 bp, C. elegans
ttgcgcgtcaaat

SEQ ID NO: 737893 - DNA, 13 bp, C. elegans
ttgcggaaaaatg

SEQ ID NO: 737894 - DNA, 13 bp, C. elegans
ttgcggaaaaatt

SEQ ID NO: 737895 - DNA, 13 bp, C. elegans
ttgcggaattttt

SEQ ID NO: 737896 - DNA, 13 bp, C. elegans
ttgcggatttgcc

SEQ ID NO: 737897 - DNA, 13 bp, C. elegans
ttgcggattttta

SEQ ID NO: 737898 - DNA, 13 bp, C. elegans
ttgcgtactcttg

SEQ ID NO: 737899 - DNA, 13 bp, C. elegans
ttgcgttgaaatt

SEQ ID NO: 737900 - DNA, 13 bp, C. elegans
ttgcgtttcaatt

SEQ ID NO: 737901 - DNA, 13 bp, C. elegans
ttgcgttttcagc

SEQ ID NO: 737902 - DNA, 13 bp, C. elegans
ttgcgtttttcac

SEQ ID NO: 737903 - DNA, 13 bp, C. elegans
ttgctaaaaactg

SEQ ID NO: 737904 - DNA, 13 bp, C. elegans
ttgctaaaaatca

SEQ ID NO: 737905 - DNA, 13 bp, C. elegans
ttgctaaaaattt

SEQ ID NO: 737906 - DNA, 13 bp, C. elegans
ttgctaaacaatt

SEQ ID NO: 737907 - DNA, 13 bp, C. elegans
ttgctaatttgcc

SEQ ID NO: 737908 - DNA, 13 bp, C. elegans
ttgctagaagttt

SEQ ID NO: 737909 - DNA, 13 bp, C. elegans
ttgctagttttta

SEQ ID NO: 737910 - DNA, 13 bp, C. elegans
ttgctataaaaaa

SEQ ID NO: 737911 - DNA, 13 bp, C. elegans
ttgctataaattg

SEQ ID NO: 737912 - DNA, 13 bp, C. elegans
ttgctatattttg

SEQ ID NO: 737913 - DNA, 13 bp, C. elegans
ttgctcaaaaaaa

SEQ ID NO: 737914 - DNA, 13 bp, C. elegans
ttgctcaaaaatg

SEQ ID NO: 737915 - DNA, 13 bp, C. elegans
ttgctcaaaaatt

SEQ ID NO: 737916 - DNA, 13 bp, C. elegans
ttgctcaaaactt

SEQ ID NO: 737917 - DNA, 13 bp, C. elegans
ttgctcaaaagtt

SEQ ID NO: 737918 - DNA, 13 bp, C. elegans
ttgctcaaaatat

SEQ ID NO: 737919 - DNA, 13 bp, C. elegans
ttgctcaaaatgc

SEQ ID NO: 737920 - DNA, 13 bp, C. elegans
ttgctcaaaattc

SEQ ID NO: 737921 - DNA, 13 bp, C. elegans
ttgctcaaataaa

SEQ ID NO: 737922 - DNA, 13 bp, C. elegans
ttgctcaaatttc

SEQ ID NO: 737923 - DNA, 13 bp, C. elegans
ttgctcaaatttt

SEQ ID NO: 737924 - DNA, 13 bp, C. elegans
ttgctcaacattt

SEQ ID NO: 737925 - DNA, 13 bp, C. elegans
ttgctcaactttg

SEQ ID NO: 737926 - DNA, 13 bp, C. elegans
ttgctcaactttt

SEQ ID NO: 737927 - DNA, 13 bp, C. elegans
ttgctcaaggtgc

SEQ ID NO: 737928 - DNA, 13 bp, C. elegans
ttgctcaataaca

SEQ ID NO: 737929 - DNA, 13 bp, C. elegans
ttgctcaatttct

SEQ ID NO: 737930 - DNA, 13 bp, C. elegans
ttgctcaccgagc

SEQ ID NO: 737931 - DNA, 13 bp, C. elegans
ttgctcactttta

SEQ ID NO: 737932 - DNA, 13 bp, C. elegans
ttgctcacttttt

SEQ ID NO: 737933 - DNA, 13 bp, C. elegans
ttgctcatattcc

SEQ ID NO: 737934 - DNA, 13 bp, C. elegans
ttgctcattcatt

SEQ ID NO: 737935 - DNA, 13 bp, C. elegans
ttgctcattttct

SEQ ID NO: 737936 - DNA, 13 bp, C. elegans
ttgctccaaaaag

SEQ ID NO: 737937 - DNA, 13 bp, C. elegans
ttgctccaaaact

SEQ ID NO: 737938 - DNA, 13 bp, C. elegans
ttgctccaaaagt

SEQ ID NO: 737939 - DNA, 13 bp, C. elegans
ttgctccaaactt

SEQ ID NO: 737940 - DNA, 13 bp, C. elegans
ttgctccaaatga

SEQ ID NO: 737941 - DNA, 13 bp, C. elegans
ttgctccacttcc

SEQ ID NO: 737942 - DNA, 13 bp, C. elegans
ttgctccgtgagc

SEQ ID NO: 737943 - DNA, 13 bp, C. elegans
ttgctcgaaaaat

SEQ ID NO: 737944 - DNA, 13 bp, C. elegans
ttgctcgcggagc

SEQ ID NO: 737945 - DNA, 13 bp, C. elegans
ttgctcggcgagc

SEQ ID NO: 737946 - DNA, 13 bp, C. elegans
ttgctcgtcaaat

SEQ ID NO: 737947 - DNA, 13 bp, C. elegans
ttgctctactttg

SEQ ID NO: 737948 - DNA, 13 bp, C. elegans
ttgctctcatttt

SEQ ID NO: 737949 - DNA, 13 bp, C. elegans
ttgctctgaaaaa

SEQ ID NO: 737950 - DNA, 13 bp, C. elegans
ttgctctgaaatt

SEQ ID NO: 737951 - DNA, 13 bp, C. elegans
ttgctctgaattt

SEQ ID NO: 737952 - DNA, 13 bp, C. elegans
ttgctgaaaaaaa

SEQ ID NO: 737953 - DNA, 13 bp, C. elegans
ttgctgaaaaagt

SEQ ID NO: 737954 - DNA, 13 bp, C. elegans
ttgctgaaaatgc

SEQ ID NO: 737955 - DNA, 13 bp, C. elegans
ttgctgaaagttg

SEQ ID NO: 737956 - DNA, 13 bp, C. elegans
ttgctgaaattaa

SEQ ID NO: 737957 - DNA, 13 bp, C. elegans
ttgctgaaatttc

SEQ ID NO: 737958 - DNA, 13 bp, C. elegans
ttgctgaatttgt

SEQ ID NO: 737959 - DNA, 13 bp, C. elegans
ttgctgcaaaatt

SEQ ID NO: 737960 - DNA, 13 bp, C. elegans
ttgctgcaaattt

SEQ ID NO: 737961 - DNA, 13 bp, C. elegans
ttgctggaaaaac

SEQ ID NO: 737962 - DNA, 14 bp, C. elegans
ttgctggaaaaatc

SEQ ID NO: 737963 - DNA, 13 bp, C. elegans
ttgctggaaagtt

SEQ ID NO: 737964 - DNA, 13 bp, C. elegans
ttgctggaaattt

SEQ ID NO: 737965 - DNA, 13 bp, C. elegans
ttgctgtaaaaat

SEQ ID NO: 737966 - DNA, 13 bp, C. elegans
ttgctgtaaaatt

SEQ ID NO: 737967 - DNA, 13 bp, C. elegans
ttgctgtaatttt

SEQ ID NO: 737968 - DNA, 14 bp, C. elegans
ttgctgtattataa

SEQ ID NO: 737969 - DNA, 13 bp, C. elegans
ttgctgtgaaatt

SEQ ID NO: 737970 - DNA, 13 bp, C. elegans
ttgctgtttttca

SEQ ID NO: 737971 - DNA, 13 bp, C. elegans
ttgcttaaaaaat

SEQ ID NO: 737972 - DNA, 13 bp, C. elegans
ttgcttaaataga

SEQ ID NO: 737973 - DNA, 13 bp, C. elegans
ttgcttcaaagtt

SEQ ID NO: 737974 - DNA, 13 bp, C. elegans
ttgcttcaaattt

SEQ ID NO: 737975 - DNA, 13 bp, C. elegans
ttgcttcaatttc

SEQ ID NO: 737976 - DNA, 13 bp, C. elegans
ttgcttctgaaaa

SEQ ID NO: 737977 - DNA, 13 bp, C. elegans
ttgcttcttttca

SEQ ID NO: 737978 - DNA, 13 bp, C. elegans
ttgcttgaaattg

SEQ ID NO: 737979 - DNA, 13 bp, C. elegans
ttgctttaaaaat

SEQ ID NO: 737980 - DNA, 13 bp, C. elegans
ttgctttaaaaca

SEQ ID NO: 737981 - DNA, 13 bp, C. elegans
ttgctttacaatt

SEQ ID NO: 737982 - DNA, 13 bp, C. elegans
ttgctttatcaga

SEQ ID NO: 737983 - DNA, 13 bp, C. elegans
ttgctttattaaa

SEQ ID NO: 737984 - DNA, 13 bp, C. elegans
ttgctttattaga

SEQ ID NO: 737985 - DNA, 13 bp, C. elegans
ttgctttcaaatt

SEQ ID NO: 737986 - DNA, 13 bp, C. elegans
ttgctttcaattt

SEQ ID NO: 737987 - DNA, 13 bp, C. elegans
ttgctttgaattt

SEQ ID NO: 737988 - DNA, 13 bp, C. elegans
ttgcttttaaaac

SEQ ID NO: 737989 - DNA, 13 bp, C. elegans
ttgcttttccaaa

SEQ ID NO: 737990 - DNA, 13 bp, C. elegans
ttgcttttctgaa

SEQ ID NO: 737991 - DNA, 13 bp, C. elegans
ttgcttttgaaaa

SEQ ID NO: 737992 - DNA, 13 bp, C. elegans
ttgctttttcaat

SEQ ID NO: 737993 - DNA, 13 bp, C. elegans
ttggaaaaaaaac

SEQ ID NO: 737994 - DNA, 13 bp, C. elegans
ttggaaaaaaatg

SEQ ID NO: 737995 - DNA, 13 bp, C. elegans
ttggaaaaaaatt

SEQ ID NO: 737996 - DNA, 13 bp, C. elegans
ttggaaaaaacgg

SEQ ID NO: 737997 - DNA, 13 bp, C. elegans
ttggaaaaaagga

SEQ ID NO: 737998 - DNA, 13 bp, C. elegans
ttggaaaaaaggt

SEQ ID NO: 737999 - DNA, 13 bp, C. elegans
ttggaaaaacacc

SEQ ID NO: 738000 - DNA, 13 bp, C. elegans
ttggaaaaacgaa

SEQ ID NO: 738001 - DNA, 13 bp, C. elegans
ttggaaaaaggaa

SEQ ID NO: 738002 - DNA, 13 bp, C. elegans
ttggaaaaagtat

SEQ ID NO: 738003 - DNA, 13 bp, C. elegans
ttggaaaaagttt

SEQ ID NO: 738004 - DNA, 13 bp, C. elegans
ttggaaaaatact

SEQ ID NO: 738005 - DNA, 13 bp, C. elegans
ttggaaaaatatc

SEQ ID NO: 738006 - DNA, 13 bp, C. elegans
ttggaaaaatcga

SEQ ID NO: 738007 - DNA, 13 bp, C. elegans
ttggaaaaatgac

SEQ ID NO: 738008 - DNA, 13 bp, C. elegans
ttggaaaaatgga

SEQ ID NO: 738009 - DNA, 13 bp, C. elegans
ttggaaaaatggg

SEQ ID NO: 738010 - DNA, 13 bp, C. elegans
ttggaaaaattca

SEQ ID NO: 738011 - DNA, 13 bp, C. elegans
ttggaaaacaaaa

SEQ ID NO: 738012 - DNA, 13 bp, C. elegans
ttggaaaacaaag

SEQ ID NO: 738013 - DNA, 13 bp, C. elegans
ttggaaaacgttc

SEQ ID NO: 738014 - DNA, 13 bp, C. elegans
ttggaaaacttaa

SEQ ID NO: 738015 - DNA, 13 bp, C. elegans
ttggaaaacttct

SEQ ID NO: 738016 - DNA, 13 bp, C. elegans
ttggaaaactttt

SEQ ID NO: 738017 - DNA, 13 bp, C. elegans
ttggaaaagaaca

SEQ ID NO: 738018 - DNA, 13 bp, C. elegans
ttggaaaagagaa

SEQ ID NO: 738019 - DNA, 13 bp, C. elegans
ttggaaaagatgg

SEQ ID NO: 738020 - DNA, 13 bp, C. elegans
ttggaaaagttga

SEQ ID NO: 738021 - DNA, 13 bp, C. elegans
ttggaaaataaat

SEQ ID NO: 738022 - DNA, 13 bp, C. elegans
ttggaaaataact

SEQ ID NO: 738023 - DNA, 13 bp, C. elegans
ttggaaaataatt

SEQ ID NO: 738024 - DNA, 13 bp, C. elegans
ttggaaaatattc

SEQ ID NO: 738025 - DNA, 13 bp, C. elegans
ttggaaaatattt

SEQ ID NO: 738026 - DNA, 13 bp, C. elegans
ttggaaaatcaat

SEQ ID NO: 738027 - DNA, 13 bp, C. elegans
ttggaaaatcaga

SEQ ID NO: 738028 - DNA, 13 bp, C. elegans
ttggaaaatctgc

SEQ ID NO: 738029 - DNA, 13 bp, C. elegans
ttggaaaatgatt

SEQ ID NO: 738030 - DNA, 13 bp, C. elegans
ttggaaaatggga

SEQ ID NO: 738031 - DNA, 13 bp, C. elegans
ttggaaaattaac

SEQ ID NO: 738032 - DNA, 13 bp, C. elegans
ttggaaaattata

SEQ ID NO: 738033 - DNA, 13 bp, C. elegans
ttggaaaattcat

SEQ ID NO: 738034 - DNA, 14 bp, C. elegans
ttggaaaattgtga

SEQ ID NO: 738035 - DNA, 13 bp, C. elegans
ttggaaaatttgg

SEQ ID NO: 738036 - DNA, 13 bp, C. elegans
ttggaaaattttt

SEQ ID NO: 738037 - DNA, 13 bp, C. elegans
ttggaaacaaaat

SEQ ID NO: 738038 - DNA, 13 bp, C. elegans
ttggaaactacag

SEQ ID NO: 738039 - DNA, 13 bp, C. elegans
ttggaaactgaaa

SEQ ID NO: 738040 - DNA, 13 bp, C. elegans
ttggaaacttaaa

SEQ ID NO: 738041 - DNA, 13 bp, C. elegans
ttggaaacttatt

SEQ ID NO: 738042 - DNA, 13 bp, C. elegans
ttggaaagaaatt

SEQ ID NO: 738043 - DNA, 13 bp, C. elegans
ttggaaagagaaa

SEQ ID NO: 738044 - DNA, 13 bp, C. elegans
ttggaaagctttt

SEQ ID NO: 738045 - DNA, 13 bp, C. elegans
ttggaaagttgaa

SEQ ID NO: 738046 - DNA, 13 bp, C. elegans
ttggaaagttgtt

SEQ ID NO: 738047 - DNA, 13 bp, C. elegans
ttggaaagtttga

SEQ ID NO: 738048 - DNA, 13 bp, C. elegans
ttggaaataaaac

SEQ ID NO: 738049 - DNA, 13 bp, C. elegans
ttggaaataaaca

SEQ ID NO: 738050 - DNA, 13 bp, C. elegans
ttggaaataatct

SEQ ID NO: 738051 - DNA, 13 bp, C. elegans
ttggaaataattt

SEQ ID NO: 738052 - DNA, 13 bp, C. elegans
ttggaaatatatt

SEQ ID NO: 738053 - DNA, 13 bp, C. elegans
ttggaaatattta

SEQ ID NO: 738054 - DNA, 13 bp, C. elegans
ttggaaatatttt

SEQ ID NO: 738055 - DNA, 13 bp, C. elegans
ttggaaatcattt

SEQ ID NO: 738056 - DNA, 13 bp, C. elegans
ttggaaatcgacc

SEQ ID NO: 738057 - DNA, 13 bp, C. elegans
ttggaaatctgaa

SEQ ID NO: 738058 - DNA, 13 bp, C. elegans
ttggaaatgaatt

SEQ ID NO: 738059 - DNA, 13 bp, C. elegans
ttggaaatgatgg

SEQ ID NO: 738060 - DNA, 13 bp, C. elegans
ttggaaatgattt

SEQ ID NO: 738061 - DNA, 13 bp, C. elegans
ttggaaatggatt

SEQ ID NO: 738062 - DNA, 13 bp, C. elegans
ttggaaatgtttc

SEQ ID NO: 738063 - DNA, 13 bp, C. elegans
ttggaaattaaca

SEQ ID NO: 738064 - DNA, 13 bp, C. elegans
ttggaaattcaaa

SEQ ID NO: 738065 - DNA, 13 bp, C. elegans
ttggaaattgaca

SEQ ID NO: 738066 - DNA, 13 bp, C. elegans
ttggaaatttaaa

SEQ ID NO: 738067 - DNA, 13 bp, C. elegans
ttggaaatttccg

SEQ ID NO: 738068 - DNA, 13 bp, C. elegans
ttggaaattttag

SEQ ID NO: 738069 - DNA, 13 bp, C. elegans
ttggaaattttcg

SEQ ID NO: 738070 - DNA, 13 bp, C. elegans
ttggaaattttct

SEQ ID NO: 738071 - DNA, 13 bp, C. elegans
ttggaaattttta

SEQ ID NO: 738072 - DNA, 13 bp, C. elegans
ttggaacaaaaac

SEQ ID NO: 738073 - DNA, 13 bp, C. elegans
ttggaacaaaaat

SEQ ID NO: 738074 - DNA, 13 bp, C. elegans
ttggaacaaaatt

SEQ ID NO: 738075 - DNA, 13 bp, C. elegans
ttggaacactttt

SEQ ID NO: 738076 - DNA, 13 bp, C. elegans
ttggaacatattt

SEQ ID NO: 738077 - DNA, 13 bp, C. elegans
ttggaacatttct

SEQ ID NO: 738078 - DNA, 13 bp, C. elegans
ttggaactgaaaa

SEQ ID NO: 738079 - DNA, 13 bp, C. elegans
ttggaactttaaa

SEQ ID NO: 738080 - DNA, 13 bp, C. elegans
ttggaactttatt

SEQ ID NO: 738081 - DNA, 13 bp, C. elegans
ttggaactttttc

SEQ ID NO: 738082 - DNA, 13 bp, C. elegans
ttggaagaaaaac

SEQ ID NO: 738083 - DNA, 13 bp, C. elegans
ttggaagaaaaag

SEQ ID NO: 738084 - DNA, 13 bp, C. elegans
ttggaagaaaaga

SEQ ID NO: 738085 - DNA, 13 bp, C. elegans
ttggaagaaaatg

SEQ ID NO: 738086 - DNA, 13 bp, C. elegans
ttggaagaaagaa

SEQ ID NO: 738087 - DNA, 13 bp, C. elegans
ttggaagaaattg

SEQ ID NO: 738088 - DNA, 13 bp, C. elegans
ttggaagaagaag

SEQ ID NO: 738089 - DNA, 13 bp, C. elegans
ttggaagaagttt

SEQ ID NO: 738090 - DNA, 13 bp, C. elegans
ttggaagaatttc

SEQ ID NO: 738091 - DNA, 13 bp, C. elegans
ttggaagatttta

SEQ ID NO: 738092 - DNA, 13 bp, C. elegans
ttggaagcaaaat

SEQ ID NO: 738093 - DNA, 13 bp, C. elegans
ttggaagcatttt

SEQ ID NO: 738094 - DNA, 13 bp, C. elegans
ttggaagtctatt

SEQ ID NO: 738095 - DNA, 13 bp, C. elegans
ttggaagtttaaa

SEQ ID NO: 738096 - DNA, 13 bp, C. elegans
ttggaagtttgaa

SEQ ID NO: 738097 - DNA, 13 bp, C. elegans
ttggaagttttag

SEQ ID NO: 738098 - DNA, 13 bp, C. elegans
ttggaataaatgt

SEQ ID NO: 738099 - DNA, 13 bp, C. elegans
ttggaataataaa

SEQ ID NO: 738100 - DNA, 13 bp, C. elegans
ttggaataatttc

SEQ ID NO: 738101 - DNA, 13 bp, C. elegans
ttggaatacaaat

SEQ ID NO: 738102 - DNA, 13 bp, C. elegans
ttggaatatgaaa

SEQ ID NO: 738103 - DNA, 13 bp, C. elegans
ttggaatattcta

SEQ ID NO: 738104 - DNA, 13 bp, C. elegans
ttggaatattctt

SEQ ID NO: 738105 - DNA, 13 bp, C. elegans
ttggaatatttaa

SEQ ID NO: 738106 - DNA, 13 bp, C. elegans
ttggaatattttc

SEQ ID NO: 738107 - DNA, 13 bp, C. elegans
ttggaatattttg

SEQ ID NO: 738108 - DNA, 13 bp, C. elegans
ttggaatcagaaa

SEQ ID NO: 738109 - DNA, 13 bp, C. elegans
ttggaatctgctt

SEQ ID NO: 738110 - DNA, 13 bp, C. elegans
ttggaatggaaaa

SEQ ID NO: 738111 - DNA, 13 bp, C. elegans
ttggaatgtttca

SEQ ID NO: 738112 - DNA, 13 bp, C. elegans
ttggaattaaaaa

SEQ ID NO: 738113 - DNA, 13 bp, C. elegans
ttggaattattga

SEQ ID NO: 738114 - DNA, 13 bp, C. elegans
ttggaattcaaat

SEQ ID NO: 738115 - DNA, 13 bp, C. elegans
ttggaattgaaaa

SEQ ID NO: 738116 - DNA, 13 bp, C. elegans
ttggaattgaaat

SEQ ID NO: 738117 - DNA, 13 bp, C. elegans
ttggaattggaaa

SEQ ID NO: 738118 - DNA, 13 bp, C. elegans
ttggaatttcaaa

SEQ ID NO: 738119 - DNA, 13 bp, C. elegans
ttggaatttcaat

SEQ ID NO: 738120 - DNA, 13 bp, C. elegans
ttggaatttccaa

SEQ ID NO: 738121 - DNA, 13 bp, C. elegans
ttggaatttcttc

SEQ ID NO: 738122 - DNA, 13 bp, C. elegans
ttggaatttgaaa

SEQ ID NO: 738123 - DNA, 13 bp, C. elegans
ttggaatttgcaa

SEQ ID NO: 738124 - DNA, 13 bp, C. elegans
ttggaattttaaa

SEQ ID NO: 738125 - DNA, 13 bp, C. elegans
ttggaattttata

SEQ ID NO: 738126 - DNA, 13 bp, C. elegans
ttggaattttatg

SEQ ID NO: 738127 - DNA, 13 bp, C. elegans
ttggaattttcaa

SEQ ID NO: 738128 - DNA, 13 bp, C. elegans
ttggaattttcgg

SEQ ID NO: 738129 - DNA, 13 bp, C. elegans
ttggaattttctt

SEQ ID NO: 738130 - DNA, 13 bp, C. elegans
ttggaattttgaa

SEQ ID NO: 738131 - DNA, 13 bp, C. elegans
ttggaattttggt

SEQ ID NO: 738132 - DNA, 13 bp, C. elegans
ttggaatttttct

SEQ ID NO: 738133 - DNA, 13 bp, C. elegans
ttggaattttttc

SEQ ID NO: 738134 - DNA, 13 bp, C. elegans
ttggacaaaaaaa

SEQ ID NO: 738135 - DNA, 13 bp, C. elegans
ttggacacttttt

SEQ ID NO: 738136 - DNA, 28 bp, C. elegans
ttggacatcccccgagttcttcgggtct

SEQ ID NO: 738137 - DNA, 13 bp, C. elegans
ttggacatggtgc

SEQ ID NO: 738138 - DNA, 13 bp, C. elegans
ttggacatttgtt

SEQ ID NO: 738139 - DNA, 13 bp, C. elegans
ttggacatttttg

SEQ ID NO: 738140 - DNA, 13 bp, C. elegans
ttggaccaaaaac

SEQ ID NO: 738141 - DNA, 13 bp, C. elegans
ttggacgtttttt

SEQ ID NO: 738142 - DNA, 13 bp, C. elegans
ttggactaaaaaa

SEQ ID NO: 738143 - DNA, 13 bp, C. elegans
ttggactgaaaat

SEQ ID NO: 738144 - DNA, 13 bp, C. elegans
ttggagaaaaagg

SEQ ID NO: 738145 - DNA, 13 bp, C. elegans
ttggagaaaaatc

SEQ ID NO: 738146 - DNA, 13 bp, C. elegans
ttggagaaaaatt

SEQ ID NO: 738147 - DNA, 13 bp, C. elegans
ttggagaaaataa

SEQ ID NO: 738148 - DNA, 13 bp, C. elegans
ttggagaaaatca

SEQ ID NO: 738149 - DNA, 13 bp, C. elegans
ttggagaaaatta

SEQ ID NO: 738150 - DNA, 13 bp, C. elegans
ttggagaacattt

SEQ ID NO: 738151 - DNA, 13 bp, C. elegans
ttggagaagtttt

SEQ ID NO: 738152 - DNA, 13 bp, C. elegans
ttggagaatttaa

SEQ ID NO: 738153 - DNA, 13 bp, C. elegans
ttggagagaaatt

SEQ ID NO: 738154 - DNA, 13 bp, C. elegans
ttggagagagaga

SEQ ID NO: 738155 - DNA, 13 bp, C. elegans
ttggagagatcat

SEQ ID NO: 738156 - DNA, 13 bp, C. elegans
ttggagagcaaca

SEQ ID NO: 738157 - DNA, 13 bp, C. elegans
ttggagatgagcc

SEQ ID NO: 738158 - DNA, 13 bp, C. elegans
ttggagcaaaaat

SEQ ID NO: 738159 - DNA, 13 bp, C. elegans
ttggagcaattct

SEQ ID NO: 738160 - DNA, 13 bp, C. elegans
ttggagcaatttg

SEQ ID NO: 738161 - DNA, 13 bp, C. elegans
ttggagcacaaaa

SEQ ID NO: 738162 - DNA, 13 bp, C. elegans
ttggagcaccaaa

SEQ ID NO: 738163 - DNA, 13 bp, C. elegans
ttggagcattttg

SEQ ID NO: 738164 - DNA, 13 bp, C. elegans
ttggagctaaatt

SEQ ID NO: 738165 - DNA, 13 bp, C. elegans
ttggagctgaaaa

SEQ ID NO: 738166 - DNA, 13 bp, C. elegans
ttggagctgaaga

SEQ ID NO: 738167 - DNA, 13 bp, C. elegans
ttggaggaaaatt

SEQ ID NO: 738168 - DNA, 13 bp, C. elegans
ttggaggaatttt

SEQ ID NO: 738169 - DNA, 13 bp, C. elegans
ttggagggaaaaa

SEQ ID NO: 738170 - DNA, 13 bp, C. elegans
ttggagggatatt

SEQ ID NO: 738171 - DNA, 13 bp, C. elegans
ttggagtactgta

SEQ ID NO: 738172 - DNA, 13 bp, C. elegans
ttggagttttcaa

SEQ ID NO: 738173 - DNA, 13 bp, C. elegans
ttggagtttttca

SEQ ID NO: 738174 - DNA, 13 bp, C. elegans
ttggataaaaaac

SEQ ID NO: 738175 - DNA, 13 bp, C. elegans
ttggataacattt

SEQ ID NO: 738176 - DNA, 13 bp, C. elegans
ttggataatttga

SEQ ID NO: 738177 - DNA, 13 bp, C. elegans
ttggatatttcaa

SEQ ID NO: 738178 - DNA, 13 bp, C. elegans
ttggatcagaagc

SEQ ID NO: 738179 - DNA, 13 bp, C. elegans
ttggatcattttg

SEQ ID NO: 738180 - DNA, 13 bp, C. elegans
ttggatcttttac

SEQ ID NO: 738181 - DNA, 13 bp, C. elegans
ttggattaaaaat

SEQ ID NO: 738182 - DNA, 13 bp, C. elegans
ttggattaaactt

SEQ ID NO: 738183 - DNA, 13 bp, C. elegans
ttggattatcatg

SEQ ID NO: 738184 - DNA, 13 bp, C. elegans
ttggatttcaaaa

SEQ ID NO: 738185 - DNA, 13 bp, C. elegans
ttggatttgaaat

SEQ ID NO: 738186 - DNA, 13 bp, C. elegans
ttggattttaaat

SEQ ID NO: 738187 - DNA, 13 bp, C. elegans
ttggattttcttg

SEQ ID NO: 738188 - DNA, 13 bp, C. elegans
ttggattttgaga

SEQ ID NO: 738189 - DNA, 13 bp, C. elegans
ttggattttgcaa

SEQ ID NO: 738190 - DNA, 13 bp, C. elegans
ttggattttggaa

SEQ ID NO: 738191 - DNA, 13 bp, C. elegans
ttggattttttca

SEQ ID NO: 738192 - DNA, 13 bp, C. elegans
ttggcaaaatatg

SEQ ID NO: 738193 - DNA, 13 bp, C. elegans
ttggcaaaatgcc

SEQ ID NO: 738194 - DNA, 13 bp, C. elegans
ttggcaaaattgt

SEQ ID NO: 738195 - DNA, 13 bp, C. elegans
ttggcaaatgttt

SEQ ID NO: 738196 - DNA, 13 bp, C. elegans
ttggcaaattgcc

SEQ ID NO: 738197 - DNA, 13 bp, C. elegans
ttggcaaatttcc

SEQ ID NO: 738198 - DNA, 13 bp, C. elegans
ttggcaacaaaaa

SEQ ID NO: 738199 - DNA, 13 bp, C. elegans
ttggcaacttatt

SEQ ID NO: 738200 - DNA, 13 bp, C. elegans
ttggcaacttctc

SEQ ID NO: 738201 - DNA, 13 bp, C. elegans
ttggcaactttct

SEQ ID NO: 738202 - DNA, 13 bp, C. elegans
ttggcaacttttc

SEQ ID NO: 738203 - DNA, 13 bp, C. elegans
ttggcaagaattt

SEQ ID NO: 738204 - DNA, 13 bp, C. elegans
ttggcaagagttg

SEQ ID NO: 738205 - DNA, 13 bp, C. elegans
ttggcaattgaaa

SEQ ID NO: 738206 - DNA, 13 bp, C. elegans
ttggcaatttccg

SEQ ID NO: 738207 - DNA, 13 bp, C. elegans
ttggcaatttgtg

SEQ ID NO: 738208 - DNA, 14 bp, C. elegans
ttggcaattttcag

SEQ ID NO: 738209 - DNA, 13 bp, C. elegans
ttggcaattttta

SEQ ID NO: 738210 - DNA, 13 bp, C. elegans
ttggcacaaaaaa

SEQ ID NO: 738211 - DNA, 13 bp, C. elegans
ttggcacaaaatg

SEQ ID NO: 738212 - DNA, 13 bp, C. elegans
ttggcacagtgcc

SEQ ID NO: 738213 - DNA, 13 bp, C. elegans
ttggcacattttc

SEQ ID NO: 738214 - DNA, 13 bp, C. elegans
ttggcagaaaaaa

SEQ ID NO: 738215 - DNA, 13 bp, C. elegans
ttggcagaaaaac

SEQ ID NO: 738216 - DNA, 13 bp, C. elegans
ttggcagaaaatt

SEQ ID NO: 738217 - DNA, 13 bp, C. elegans
ttggcagacgaaa

SEQ ID NO: 738218 - DNA, 13 bp, C. elegans
ttggcagatttta

SEQ ID NO: 738219 - DNA, 13 bp, C. elegans
ttggcaggaaatt

SEQ ID NO: 738220 - DNA, 13 bp, C. elegans
ttggcatattttt

SEQ ID NO: 738221 - DNA, 13 bp, C. elegans
ttggcatctgcat

SEQ ID NO: 738222 - DNA, 13 bp, C. elegans
ttggcattttcaa

SEQ ID NO: 738223 - DNA, 13 bp, C. elegans
ttggcatttttca

SEQ ID NO: 738224 - DNA, 13 bp, C. elegans
ttggcatttttcg

SEQ ID NO: 738225 - DNA, 13 bp, C. elegans
ttggccaaaaatt

SEQ ID NO: 738226 - DNA, 13 bp, C. elegans
ttggccaaaattt

SEQ ID NO: 738227 - DNA, 13 bp, C. elegans
ttggccaatgtac

SEQ ID NO: 738228 - DNA, 13 bp, C. elegans
ttggccaattttt

SEQ ID NO: 738229 - DNA, 13 bp, C. elegans
ttggccacttttc

SEQ ID NO: 738230 - DNA, 13 bp, C. elegans
ttggcccaagttt

SEQ ID NO: 738231 - DNA, 13 bp, C. elegans
ttggccccgccca

SEQ ID NO: 738232 - DNA, 13 bp, C. elegans
ttggccggaaatt

SEQ ID NO: 738233 - DNA, 13 bp, C. elegans
ttggccgtggagc

SEQ ID NO: 738234 - DNA, 13 bp, C. elegans
ttggcctaaaaat

SEQ ID NO: 738235 - DNA, 13 bp, C. elegans
ttggcctaaaatt

SEQ ID NO: 738236 - DNA, 13 bp, C. elegans
ttggcctaatttt

SEQ ID NO: 738237 - DNA, 13 bp, C. elegans
ttggcgagaaatt

SEQ ID NO: 738238 - DNA, 13 bp, C. elegans
ttggcgatttgca

SEQ ID NO: 738239 - DNA, 13 bp, C. elegans
ttggcgatttttg

SEQ ID NO: 738240 - DNA, 13 bp, C. elegans
ttggcgcaaaaat

SEQ ID NO: 738241 - DNA, 13 bp, C. elegans
ttggcgcgaaatt

SEQ ID NO: 738242 - DNA, 13 bp, C. elegans
ttggcgctactcc

SEQ ID NO: 738243 - DNA, 13 bp, C. elegans
ttggcggaaaatc

SEQ ID NO: 738244 - DNA, 13 bp, C. elegans
ttggcggaattga

SEQ ID NO: 738245 - DNA, 13 bp, C. elegans
ttggcggaattta

SEQ ID NO: 738246 - DNA, 13 bp, C. elegans
ttggcgggaaatt

SEQ ID NO: 738247 - DNA, 13 bp, C. elegans
ttggcgggaattc

SEQ ID NO: 738248 - DNA, 13 bp, C. elegans
ttggcgtaaattt

SEQ ID NO: 738249 - DNA, 13 bp, C. elegans
ttggctaaaatca

SEQ ID NO: 738250 - DNA, 13 bp, C. elegans
ttggctaaacttg

SEQ ID NO: 738251 - DNA, 13 bp, C. elegans
ttggctaattttt

SEQ ID NO: 738252 - DNA, 13 bp, C. elegans
ttggctcaaaatt

SEQ ID NO: 738253 - DNA, 13 bp, C. elegans
ttggctcaactgg

SEQ ID NO: 738254 - DNA, 13 bp, C. elegans
ttggctcaatttt

SEQ ID NO: 738255 - DNA, 13 bp, C. elegans
ttggctcattttg

SEQ ID NO: 738256 - DNA, 13 bp, C. elegans
ttggctgaaaaaa

SEQ ID NO: 738257 - DNA, 13 bp, C. elegans
ttggctgaaaaag

SEQ ID NO: 738258 - DNA, 13 bp, C. elegans
ttggctgaaaatc

SEQ ID NO: 738259 - DNA, 13 bp, C. elegans
ttggctgaaaatt

SEQ ID NO: 738260 - DNA, 13 bp, C. elegans
ttggctgaaatta

SEQ ID NO: 738261 - DNA, 13 bp, C. elegans
ttggctggaaatt

SEQ ID NO: 738262 - DNA, 13 bp, C. elegans
ttggctggaattt

SEQ ID NO: 738263 - DNA, 13 bp, C. elegans
ttggcttaaaaac

SEQ ID NO: 738264 - DNA, 13 bp, C. elegans
ttggcttaatttt

SEQ ID NO: 738265 - DNA, 13 bp, C. elegans
ttggcttcaaaat

SEQ ID NO: 738266 - DNA, 13 bp, C. elegans
ttggcttgaaaat

SEQ ID NO: 738267 - DNA, 13 bp, C. elegans
ttggctttaaaaa

SEQ ID NO: 738268 - DNA, 13 bp, C. elegans
ttggcttttttca

SEQ ID NO: 738269 - DNA, 13 bp, C. elegans
ttgggaaaaaatc

SEQ ID NO: 738270 - DNA, 13 bp, C. elegans
ttgggaaataaat

SEQ ID NO: 738271 - DNA, 13 bp, C. elegans
ttgggaaatcaat

SEQ ID NO: 738272 - DNA, 13 bp, C. elegans
ttgggaaatgttt

SEQ ID NO: 738273 - DNA, 13 bp, C. elegans
ttgggaaatttaa

SEQ ID NO: 738274 - DNA, 13 bp, C. elegans
ttgggaagaaaaa

SEQ ID NO: 738275 - DNA, 13 bp, C. elegans
ttgggaagttttt

SEQ ID NO: 738276 - DNA, 13 bp, C. elegans
ttgggaataaaaa

SEQ ID NO: 738277 - DNA, 13 bp, C. elegans
ttgggaattcaaa

SEQ ID NO: 738278 - DNA, 13 bp, C. elegans
ttgggaatttatg

SEQ ID NO: 738279 - DNA, 13 bp, C. elegans
ttgggacaaaaat

SEQ ID NO: 738280 - DNA, 13 bp, C. elegans
ttgggagttgatg

SEQ ID NO: 738281 - DNA, 13 bp, C. elegans
ttgggccaaaaaa

SEQ ID NO: 738282 - DNA, 13 bp, C. elegans
ttgggctcaggct

SEQ ID NO: 738283 - DNA, 13 bp, C. elegans
ttggggacaaaat

SEQ ID NO: 738284 - DNA, 13 bp, C. elegans
ttggggattttta

SEQ ID NO: 738285 - DNA, 13 bp, C. elegans
ttgggggaatttt

SEQ ID NO: 738286 - DNA, 13 bp, C. elegans
ttgggggcggagc

SEQ ID NO: 738287 - DNA, 13 bp, C. elegans
ttggggtactgta

SEQ ID NO: 738288 - DNA, 13 bp, C. elegans
ttggggttttcaa

SEQ ID NO: 738289 - DNA, 13 bp, C. elegans
ttgggtcattttt

SEQ ID NO: 738290 - DNA, 18 bp, C. elegans
ttgggtcccggatgtctg

SEQ ID NO: 738291 - DNA, 13 bp, C. elegans
ttgggtcccgtca

SEQ ID NO: 738292 - DNA, 13 bp, C. elegans
ttgggtcgaaaaa

SEQ ID NO: 738293 - DNA, 13 bp, C. elegans
ttgggtgaagatc

SEQ ID NO: 738294 - DNA, 13 bp, C. elegans
ttgggtgaggctc

SEQ ID NO: 738295 - DNA, 13 bp, C. elegans
ttgggtggaaaaa

SEQ ID NO: 738296 - DNA, 13 bp, C. elegans
ttgggttactgta

SEQ ID NO: 738297 - DNA, 13 bp, C. elegans
ttggtaaaatttt

SEQ ID NO: 738298 - DNA, 13 bp, C. elegans
ttggtaaagtttt

SEQ ID NO: 738299 - DNA, 13 bp, C. elegans
ttggtaaatattt

SEQ ID NO: 738300 - DNA, 13 bp, C. elegans
ttggtaagaaaaa

SEQ ID NO: 738301 - DNA, 13 bp, C. elegans
ttggtaatccccc

SEQ ID NO: 738302 - DNA, 13 bp, C. elegans
ttggtacaaaaaa

SEQ ID NO: 738303 - DNA, 13 bp, C. elegans
ttggtacgttttt

SEQ ID NO: 738304 - DNA, 13 bp, C. elegans
ttggtagaattga

SEQ ID NO: 738305 - DNA, 13 bp, C. elegans
ttggtattcaaaa

SEQ ID NO: 738306 - DNA, 13 bp, C. elegans
ttggtatttagaa

SEQ ID NO: 738307 - DNA, 13 bp, C. elegans
ttggtattttcag

SEQ ID NO: 738308 - DNA, 13 bp, C. elegans
ttggtattttctg

SEQ ID NO: 738309 - DNA, 13 bp, C. elegans
ttggtatttttcg

SEQ ID NO: 738310 - DNA, 13 bp, C. elegans
ttggtcaaaagtt

SEQ ID NO: 738311 - DNA, 13 bp, C. elegans
ttggtcaaaattg

SEQ ID NO: 738312 - DNA, 13 bp, C. elegans
ttggtcaatttca

SEQ ID NO: 738313 - DNA, 13 bp, C. elegans
ttggtcagtgcaa

SEQ ID NO: 738314 - DNA, 13 bp, C. elegans
ttggtcagtgcga

SEQ ID NO: 738315 - DNA, 13 bp, C. elegans
ttggtcagtgctt

SEQ ID NO: 738316 - DNA, 13 bp, C. elegans
ttggtcatgttgg

SEQ ID NO: 738317 - DNA, 13 bp, C. elegans
ttggtcattttgg

SEQ ID NO: 738318 - DNA, 13 bp, C. elegans
ttggtcattttgt

SEQ ID NO: 738319 - DNA, 13 bp, C. elegans
ttggtccagtttt

SEQ ID NO: 738320 - DNA, 13 bp, C. elegans
ttggtcgtttatc

SEQ ID NO: 738321 - DNA, 14 bp, C. elegans
ttggtctcgacacg

SEQ ID NO: 738322 - DNA, 13 bp, C. elegans
ttggtgaaaaaaa

SEQ ID NO: 738323 - DNA, 13 bp, C. elegans
ttggtgaaataaa

SEQ ID NO: 738324 - DNA, 13 bp, C. elegans
ttggtgaattttg

SEQ ID NO: 738325 - DNA, 13 bp, C. elegans
ttggtgatttgcc

SEQ ID NO: 738326 - DNA, 13 bp, C. elegans
ttggtgcaatttt

SEQ ID NO: 738327 - DNA, 13 bp, C. elegans
ttggtgctatttg

SEQ ID NO: 738328 - DNA, 13 bp, C. elegans
ttggtggaaaatg

SEQ ID NO: 738329 - DNA, 13 bp, C. elegans
ttggtggaaattt

SEQ ID NO: 738330 - DNA, 13 bp, C. elegans
ttggtgggaaatt

SEQ ID NO: 738331 - DNA, 13 bp, C. elegans
ttggtgtcgattt

SEQ ID NO: 738332 - DNA, 13 bp, C. elegans
ttggttaaaaact

SEQ ID NO: 738333 - DNA, 13 bp, C. elegans
ttggttaaaaata

SEQ ID NO: 738334 - DNA, 13 bp, C. elegans
ttggttaaatatt

SEQ ID NO: 738335 - DNA, 13 bp, C. elegans
ttggttattgaaa

SEQ ID NO: 738336 - DNA, 13 bp, C. elegans
ttggttcaaaaaa

SEQ ID NO: 738337 - DNA, 13 bp, C. elegans
ttggttcaaaagt

SEQ ID NO: 738338 - DNA, 13 bp, C. elegans
ttggttccaaaat

SEQ ID NO: 738339 - DNA, 13 bp, C. elegans
ttggttccaattt

SEQ ID NO: 738340 - DNA, 13 bp, C. elegans
ttggttcgattcc

SEQ ID NO: 738341 - DNA, 14 bp, C. elegans
ttggttctggagtt

SEQ ID NO: 738342 - DNA, 13 bp, C. elegans
ttggttgaaaaat

SEQ ID NO: 738343 - DNA, 13 bp, C. elegans
ttggttgaaaatt

SEQ ID NO: 738344 - DNA, 13 bp, C. elegans
ttggtttaaaaac

SEQ ID NO: 738345 - DNA, 13 bp, C. elegans
ttggtttaaaatt

SEQ ID NO: 738346 - DNA, 13 bp, C. elegans
ttggtttgaaaat

SEQ ID NO: 738347 - DNA, 13 bp, C. elegans
ttggttttcaatt

SEQ ID NO: 738348 - DNA, 13 bp, C. elegans
ttggttttggaaa

SEQ ID NO: 738349 - DNA, 13 bp, C. elegans
ttggttttgggaa

SEQ ID NO: 738350 - DNA, 13 bp, C. elegans
ttggtttttatca

SEQ ID NO: 738351 - DNA, 13 bp, C. elegans
ttggtttttcaaa

SEQ ID NO: 738352 - DNA, 13 bp, C. elegans
ttggtttttcaat

SEQ ID NO: 738353 - DNA, 13 bp, C. elegans
ttggtttttcgaa

SEQ ID NO: 738354 - DNA, 13 bp, C. elegans
ttggtttttctac

SEQ ID NO: 738355 - DNA, 13 bp, C. elegans
ttggtttttgact

SEQ ID NO: 738356 - DNA, 13 bp, C. elegans
ttggttttttcaa

SEQ ID NO: 738357 - DNA, 13 bp, C. elegans
ttgtaaaaaaaac

SEQ ID NO: 738358 - DNA, 13 bp, C. elegans
ttgtaaaaaaacg

SEQ ID NO: 738359 - DNA, 13 bp, C. elegans
ttgtaaaaaaagt

SEQ ID NO: 738360 - DNA, 13 bp, C. elegans
ttgtaaaaaatgt

SEQ ID NO: 738361 - DNA, 13 bp, C. elegans
ttgtaaaaaattc

SEQ ID NO: 738362 - DNA, 13 bp, C. elegans
ttgtaaaaacatg

SEQ ID NO: 738363 - DNA, 13 bp, C. elegans
ttgtaaaaactaa

SEQ ID NO: 738364 - DNA, 13 bp, C. elegans
ttgtaaaaatcga

SEQ ID NO: 738365 - DNA, 13 bp, C. elegans
ttgtaaaaatgat

SEQ ID NO: 738366 - DNA, 13 bp, C. elegans
ttgtaaaaatgtg

SEQ ID NO: 738367 - DNA, 13 bp, C. elegans
ttgtaaaaattgc

SEQ ID NO: 738368 - DNA, 13 bp, C. elegans
ttgtaaaacatta

SEQ ID NO: 738369 - DNA, 13 bp, C. elegans
ttgtaaaacgaaa

SEQ ID NO: 738370 - DNA, 13 bp, C. elegans
ttgtaaaactaaa

SEQ ID NO: 738371 - DNA, 13 bp, C. elegans
ttgtaaaactaca

SEQ ID NO: 738372 - DNA, 13 bp, C. elegans
ttgtaaaactgtt

SEQ ID NO: 738373 - DNA, 13 bp, C. elegans
ttgtaaaactttt

SEQ ID NO: 738374 - DNA, 13 bp, C. elegans
ttgtaaaagtatt

SEQ ID NO: 738375 - DNA, 13 bp, C. elegans
ttgtaaaagttca

SEQ ID NO: 738376 - DNA, 13 bp, C. elegans
ttgtaaaatgaca

SEQ ID NO: 738377 - DNA, 13 bp, C. elegans
ttgtaaaattttc

SEQ ID NO: 738378 - DNA, 13 bp, C. elegans
ttgtaaactttgt

SEQ ID NO: 738379 - DNA, 13 bp, C. elegans
ttgtaaactttta

SEQ ID NO: 738380 - DNA, 13 bp, C. elegans
ttgtaaagaaaat

SEQ ID NO: 738381 - DNA, 13 bp, C. elegans
ttgtaaagaacaa

SEQ ID NO: 738382 - DNA, 13 bp, C. elegans
ttgtaaagttaaa

SEQ ID NO: 738383 - DNA, 13 bp, C. elegans
ttgtaaataattg

SEQ ID NO: 738384 - DNA, 13 bp, C. elegans
ttgtaaatatgtt

SEQ ID NO: 738385 - DNA, 13 bp, C. elegans
ttgtaaatcaaaa

SEQ ID NO: 738386 - DNA, 13 bp, C. elegans
ttgtaaatgaatt

SEQ ID NO: 738387 - DNA, 13 bp, C. elegans
ttgtaaatgtgtg

SEQ ID NO: 738388 - DNA, 13 bp, C. elegans
ttgtaaattagct

SEQ ID NO: 738389 - DNA, 13 bp, C. elegans
ttgtaaattcaaa

SEQ ID NO: 738390 - DNA, 13 bp, C. elegans
ttgtaaatttaag

SEQ ID NO: 738391 - DNA, 13 bp, C. elegans
ttgtaaatttcta

SEQ ID NO: 738392 - DNA, 13 bp, C. elegans
ttgtaaattttca

SEQ ID NO: 738393 - DNA, 13 bp, C. elegans
ttgtaaattttga

SEQ ID NO: 738394 - DNA, 13 bp, C. elegans
ttgtaacaatttt

SEQ ID NO: 738395 - DNA, 13 bp, C. elegans
ttgtaacagtttt

SEQ ID NO: 738396 - DNA, 13 bp, C. elegans
ttgtaacattttg

SEQ ID NO: 738397 - DNA, 13 bp, C. elegans
ttgtaactgaaag

SEQ ID NO: 738398 - DNA, 13 bp, C. elegans
ttgtaacttaaaa

SEQ ID NO: 738399 - DNA, 13 bp, C. elegans
ttgtaactttgtt

SEQ ID NO: 738400 - DNA, 13 bp, C. elegans
ttgtaagattatt

SEQ ID NO: 738401 - DNA, 13 bp, C. elegans
ttgtaataaaaca

SEQ ID NO: 738402 - DNA, 13 bp, C. elegans
ttgtaataaaatg

SEQ ID NO: 738403 - DNA, 13 bp, C. elegans
ttgtaatagaaaa

SEQ ID NO: 738404 - DNA, 13 bp, C. elegans
ttgtaatattgaa

SEQ ID NO: 738405 - DNA, 13 bp, C. elegans
ttgtaatattttc

SEQ ID NO: 738406 - DNA, 13 bp, C. elegans
ttgtaattgtttc

SEQ ID NO: 738407 - DNA, 13 bp, C. elegans
ttgtaatttcaat

SEQ ID NO: 738408 - DNA, 13 bp, C. elegans
ttgtaattttcaa

SEQ ID NO: 738409 - DNA, 13 bp, C. elegans
ttgtaattttgag

SEQ ID NO: 738410 - DNA, 13 bp, C. elegans
ttgtacaaaaaaa

SEQ ID NO: 738411 - DNA, 13 bp, C. elegans
ttgtacaaaaaat

SEQ ID NO: 738412 - DNA, 13 bp, C. elegans
ttgtacaaaacaa

SEQ ID NO: 738413 - DNA, 13 bp, C. elegans
ttgtacaatattt

SEQ ID NO: 738414 - DNA, 13 bp, C. elegans
ttgtacaattttt

SEQ ID NO: 738415 - DNA, 13 bp, C. elegans
ttgtacagtttca

SEQ ID NO: 738416 - DNA, 13 bp, C. elegans
ttgtacatataca

SEQ ID NO: 738417 - DNA, 13 bp, C. elegans
ttgtacattaaaa

SEQ ID NO: 738418 - DNA, 13 bp, C. elegans
ttgtacattttgt

SEQ ID NO: 738419 - DNA, 13 bp, C. elegans
ttgtacatttttg

SEQ ID NO: 738420 - DNA, 13 bp, C. elegans
ttgtaccaaaatt

SEQ ID NO: 738421 - DNA, 13 bp, C. elegans
ttgtacgcaaaca

SEQ ID NO: 738422 - DNA, 13 bp, C. elegans
ttgtactgaaaat

SEQ ID NO: 738423 - DNA, 13 bp, C. elegans
ttgtacttaaatt

SEQ ID NO: 738424 - DNA, 13 bp, C. elegans
ttgtactttgtag

SEQ ID NO: 738425 - DNA, 13 bp, C. elegans
ttgtagaaaaaat

SEQ ID NO: 738426 - DNA, 13 bp, C. elegans
ttgtagaaaattt

SEQ ID NO: 738427 - DNA, 13 bp, C. elegans
ttgtagaaactga

SEQ ID NO: 738428 - DNA, 13 bp, C. elegans
ttgtagaaatatg

SEQ ID NO: 738429 - DNA, 13 bp, C. elegans
ttgtagaagaaaa

SEQ ID NO: 738430 - DNA, 13 bp, C. elegans
ttgtagaagtttc

SEQ ID NO: 738431 - DNA, 13 bp, C. elegans
ttgtagacaaatt

SEQ ID NO: 738432 - DNA, 13 bp, C. elegans
ttgtagaccacaa

SEQ ID NO: 738433 - DNA, 13 bp, C. elegans
ttgtagatcaaac

SEQ ID NO: 738434 - DNA, 13 bp, C. elegans
ttgtagatcaacc

SEQ ID NO: 738435 - DNA, 13 bp, C. elegans
ttgtagatcaagc

SEQ ID NO: 738436 - DNA, 13 bp, C. elegans
ttgtagatcacat

SEQ ID NO: 738437 - DNA, 13 bp, C. elegans
ttgtagatttaca

SEQ ID NO: 738438 - DNA, 13 bp, C. elegans
ttgtagcaaaaat

SEQ ID NO: 738439 - DNA, 13 bp, C. elegans
ttgtagccaatga

SEQ ID NO: 738440 - DNA, 13 bp, C. elegans
ttgtagctcaaaa

SEQ ID NO: 738441 - DNA, 13 bp, C. elegans
ttgtaggcaggca

SEQ ID NO: 738442 - DNA, 13 bp, C. elegans
ttgtagtaaaaga

SEQ ID NO: 738443 - DNA, 13 bp, C. elegans
ttgtagtctgtga

SEQ ID NO: 738444 - DNA, 13 bp, C. elegans
ttgtagtcttaaa

SEQ ID NO: 738445 - DNA, 13 bp, C. elegans
ttgtagtgaaatt

SEQ ID NO: 738446 - DNA, 13 bp, C. elegans
ttgtagttgaaca

SEQ ID NO: 738447 - DNA, 13 bp, C. elegans
ttgtagtttgtaa

SEQ ID NO: 738448 - DNA, 13 bp, C. elegans
ttgtataaaaaac

SEQ ID NO: 738449 - DNA, 13 bp, C. elegans
ttgtataaaaatc

SEQ ID NO: 738450 - DNA, 13 bp, C. elegans
ttgtatacaattt

SEQ ID NO: 738451 - DNA, 13 bp, C. elegans
ttgtatagaaaaa

SEQ ID NO: 738452 - DNA, 13 bp, C. elegans
ttgtatatttcaa

SEQ ID NO: 738453 - DNA, 13 bp, C. elegans
ttgtatattttca

SEQ ID NO: 738454 - DNA, 13 bp, C. elegans
ttgtatcaaaaat

SEQ ID NO: 738455 - DNA, 13 bp, C. elegans
ttgtatcatttta

SEQ ID NO: 738456 - DNA, 13 bp, C. elegans
ttgtatcgattta

SEQ ID NO: 738457 - DNA, 13 bp, C. elegans
ttgtatgaaaaac

SEQ ID NO: 738458 - DNA, 13 bp, C. elegans
ttgtatgtttcaa

SEQ ID NO: 738459 - DNA, 13 bp, C. elegans
ttgtattattcaa

SEQ ID NO: 738460 - DNA, 13 bp, C. elegans
ttgtattcaaaat

SEQ ID NO: 738461 - DNA, 13 bp, C. elegans
ttgtattcaaaca

SEQ ID NO: 738462 - DNA, 13 bp, C. elegans
ttgtattcaattt

SEQ ID NO: 738463 - DNA, 13 bp, C. elegans
ttgtattcagttg

SEQ ID NO: 738464 - DNA, 13 bp, C. elegans
ttgtatttcaaaa

SEQ ID NO: 738465 - DNA, 13 bp, C. elegans
ttgtatttcaaat

SEQ ID NO: 738466 - DNA, 13 bp, C. elegans
ttgtatttcagaa

SEQ ID NO: 738467 - DNA, 13 bp, C. elegans
ttgtatttccaaa

SEQ ID NO: 738468 - DNA, 13 bp, C. elegans
ttgtattttcaac

SEQ ID NO: 738469 - DNA, 13 bp, C. elegans
ttgtattttcaat

SEQ ID NO: 738470 - DNA, 13 bp, C. elegans
ttgtattttcaca

SEQ ID NO: 738471 - DNA, 13 bp, C. elegans
ttgtattttcgaa

SEQ ID NO: 738472 - DNA, 13 bp, C. elegans
ttgtattttgcaa

SEQ ID NO: 738473 - DNA, 13 bp, C. elegans
ttgtcaaaaacca

SEQ ID NO: 738474 - DNA, 13 bp, C. elegans
ttgtcaaaaatcc

SEQ ID NO: 738475 - DNA, 13 bp, C. elegans
ttgtcaaaacttt

SEQ ID NO: 738476 - DNA, 13 bp, C. elegans
ttgtcaaaatgtt

SEQ ID NO: 738477 - DNA, 13 bp, C. elegans
ttgtcaaaatttt

SEQ ID NO: 738478 - DNA, 13 bp, C. elegans
ttgtcaaactttt

SEQ ID NO: 738479 - DNA, 13 bp, C. elegans
ttgtcaaatcaaa

SEQ ID NO: 738480 - DNA, 13 bp, C. elegans
ttgtcaaattgcc

SEQ ID NO: 738481 - DNA, 13 bp, C. elegans
ttgtcaaattttg

SEQ ID NO: 738482 - DNA, 13 bp, C. elegans
ttgtcaacaaaaa

SEQ ID NO: 738483 - DNA, 13 bp, C. elegans
ttgtcaactaata

SEQ ID NO: 738484 - DNA, 13 bp, C. elegans
ttgtcaactgatt

SEQ ID NO: 738485 - DNA, 13 bp, C. elegans
ttgtcaacttttt

SEQ ID NO: 738486 - DNA, 13 bp, C. elegans
ttgtcaataaaat

SEQ ID NO: 738487 - DNA, 13 bp, C. elegans
ttgtcaataattt

SEQ ID NO: 738488 - DNA, 13 bp, C. elegans
ttgtcaatggagc

SEQ ID NO: 738489 - DNA, 13 bp, C. elegans
ttgtcaatttgcc

SEQ ID NO: 738490 - DNA, 13 bp, C. elegans
ttgtcaatttgtt

SEQ ID NO: 738491 - DNA, 13 bp, C. elegans
ttgtcaattttgt

SEQ ID NO: 738492 - DNA, 13 bp, C. elegans
ttgtcaatttttc

SEQ ID NO: 738493 - DNA, 13 bp, C. elegans
ttgtcacaaaaac

SEQ ID NO: 738494 - DNA, 13 bp, C. elegans
ttgtcacaaaaat

SEQ ID NO: 738495 - DNA, 13 bp, C. elegans
ttgtcacaaaatt

SEQ ID NO: 738496 - DNA, 13 bp, C. elegans
ttgtcacgaagtt

SEQ ID NO: 738497 - DNA, 13 bp, C. elegans
ttgtcacgttttt

SEQ ID NO: 738498 - DNA, 13 bp, C. elegans
ttgtcagaaaaat

SEQ ID NO: 738499 - DNA, 13 bp, C. elegans
ttgtcagaaagtt

SEQ ID NO: 738500 - DNA, 13 bp, C. elegans
ttgtcagattttt

SEQ ID NO: 738501 - DNA, 13 bp, C. elegans
ttgtcagtaaaaa

SEQ ID NO: 738502 - DNA, 13 bp, C. elegans
ttgtcagttggaa

SEQ ID NO: 738503 - DNA, 13 bp, C. elegans
ttgtcagtttaca

SEQ ID NO: 738504 - DNA, 13 bp, C. elegans
ttgtcagttttct

SEQ ID NO: 738505 - DNA, 13 bp, C. elegans
ttgtcatattttc

SEQ ID NO: 738506 - DNA, 13 bp, C. elegans
ttgtcatcatttc

SEQ ID NO: 738507 - DNA, 13 bp, C. elegans
ttgtcatggagca

SEQ ID NO: 738508 - DNA, 13 bp, C. elegans
ttgtcattaaaaa

SEQ ID NO: 738509 - DNA, 13 bp, C. elegans
ttgtcattgaaaa

SEQ ID NO: 738510 - DNA, 13 bp, C. elegans
ttgtcatttcatt

SEQ ID NO: 738511 - DNA, 13 bp, C. elegans
ttgtcatttcctt

SEQ ID NO: 738512 - DNA, 13 bp, C. elegans
ttgtcattttatc

SEQ ID NO: 738513 - DNA, 13 bp, C. elegans
ttgtcatttttca

SEQ ID NO: 738514 - DNA, 13 bp, C. elegans
ttgtcatttttcg

SEQ ID NO: 738515 - DNA, 13 bp, C. elegans
ttgtcatttttgc

SEQ ID NO: 738516 - DNA, 13 bp, C. elegans
ttgtccatagttt

SEQ ID NO: 738517 - DNA, 13 bp, C. elegans
ttgtccatttttc

SEQ ID NO: 738518 - DNA, 13 bp, C. elegans
ttgtcccatcacg

SEQ ID NO: 738519 - DNA, 13 bp, C. elegans
ttgtcgaaaaaac

SEQ ID NO: 738520 - DNA, 13 bp, C. elegans
ttgtcgaaaaatg

SEQ ID NO: 738521 - DNA, 13 bp, C. elegans
ttgtcgacaaaaa

SEQ ID NO: 738522 - DNA, 13 bp, C. elegans
ttgtcgacaaaat

SEQ ID NO: 738523 - DNA, 13 bp, C. elegans
ttgtcgacaaatt

SEQ ID NO: 738524 - DNA, 13 bp, C. elegans
ttgtcgacaagtt

SEQ ID NO: 738525 - DNA, 13 bp, C. elegans
ttgtcgattttcc

SEQ ID NO: 738526 - DNA, 13 bp, C. elegans
ttgtcgatttttc

SEQ ID NO: 738527 - DNA, 13 bp, C. elegans
ttgtcgatttttg

SEQ ID NO: 738528 - DNA, 13 bp, C. elegans
ttgtcggaaaaaa

SEQ ID NO: 738529 - DNA, 13 bp, C. elegans
ttgtcggaaattg

SEQ ID NO: 738530 - DNA, 13 bp, C. elegans
ttgtcggaaattt

SEQ ID NO: 738531 - DNA, 13 bp, C. elegans
ttgtcggaattga

SEQ ID NO: 738532 - DNA, 13 bp, C. elegans
ttgtcggaatttt

SEQ ID NO: 738533 - DNA, 14 bp, C. elegans
ttgtcggtcgtcaa

SEQ ID NO: 738534 - DNA, 13 bp, C. elegans
ttgtcgtcgtcgt

SEQ ID NO: 738535 - DNA, 13 bp, C. elegans
ttgtcgtttgaat

SEQ ID NO: 738536 - DNA, 13 bp, C. elegans
ttgtctaaattat

SEQ ID NO: 738537 - DNA, 13 bp, C. elegans
ttgtctaaatttt

SEQ ID NO: 738538 - DNA, 13 bp, C. elegans
ttgtctattttca

SEQ ID NO: 738539 - DNA, 13 bp, C. elegans
ttgtctcaaattt

SEQ ID NO: 738540 - DNA, 13 bp, C. elegans
ttgtctcatattt

SEQ ID NO: 738541 - DNA, 13 bp, C. elegans
ttgtctccaaaaa

SEQ ID NO: 738542 - DNA, 13 bp, C. elegans
ttgtctgaaaagt

SEQ ID NO: 738543 - DNA, 13 bp, C. elegans
ttgtctgaaaatc

SEQ ID NO: 738544 - DNA, 13 bp, C. elegans
ttgtctgaaaatg

SEQ ID NO: 738545 - DNA, 13 bp, C. elegans
ttgtctgaaattt

SEQ ID NO: 738546 - DNA, 13 bp, C. elegans
ttgtctgaatttt

SEQ ID NO: 738547 - DNA, 13 bp, C. elegans
ttgtctgcgtctc

SEQ ID NO: 738548 - DNA, 13 bp, C. elegans
ttgtctggaaaat

SEQ ID NO: 738549 - DNA, 13 bp, C. elegans
ttgtctgtaaaaa

SEQ ID NO: 738550 - DNA, 13 bp, C. elegans
ttgtctgtgtctc

SEQ ID NO: 738551 - DNA, 13 bp, C. elegans
ttgtcttcaaatt

SEQ ID NO: 738552 - DNA, 13 bp, C. elegans
ttgtcttctccga

SEQ ID NO: 738553 - DNA, 13 bp, C. elegans
ttgtcttgaaatt

SEQ ID NO: 738554 - DNA, 13 bp, C. elegans
ttgtgaaaaaatg

SEQ ID NO: 738555 - DNA, 13 bp, C. elegans
ttgtgaaaaacaa

SEQ ID NO: 738556 - DNA, 13 bp, C. elegans
ttgtgaaaaacca

SEQ ID NO: 738557 - DNA, 13 bp, C. elegans
ttgtgaaaaacta

SEQ ID NO: 738558 - DNA, 13 bp, C. elegans
ttgtgaaaaagtg

SEQ ID NO: 738559 - DNA, 14 bp, C. elegans
ttgtgaaaaatatt

SEQ ID NO: 738560 - DNA, 13 bp, C. elegans
ttgtgaaaaatca

SEQ ID NO: 738561 - DNA, 13 bp, C. elegans
ttgtgaaaaatct

SEQ ID NO: 738562 - DNA, 13 bp, C. elegans
ttgtgaaaactaa

SEQ ID NO: 738563 - DNA, 13 bp, C. elegans
ttgtgaaaactga

SEQ ID NO: 738564 - DNA, 13 bp, C. elegans
ttgtgaaaacttt

SEQ ID NO: 738565 - DNA, 13 bp, C. elegans
ttgtgaaaagtgt

SEQ ID NO: 738566 - DNA, 13 bp, C. elegans
ttgtgaaaatcga

SEQ ID NO: 738567 - DNA, 13 bp, C. elegans
ttgtgaaaattgt

SEQ ID NO: 738568 - DNA, 13 bp, C. elegans
ttgtgaaacagca

SEQ ID NO: 738569 - DNA, 13 bp, C. elegans
ttgtgaaacagta

SEQ ID NO: 738570 - DNA, 13 bp, C. elegans
ttgtgaaacatat

SEQ ID NO: 738571 - DNA, 13 bp, C. elegans
ttgtgaaactgtt

SEQ ID NO: 738572 - DNA, 13 bp, C. elegans
ttgtgaaactttt

SEQ ID NO: 738573 - DNA, 13 bp, C. elegans
ttgtgaaagattt

SEQ ID NO: 738574 - DNA, 13 bp, C. elegans
ttgtgaaagtttt

SEQ ID NO: 738575 - DNA, 13 bp, C. elegans
ttgtgaaataatt

SEQ ID NO: 738576 - DNA, 13 bp, C. elegans
ttgtgaaatgaaa

SEQ ID NO: 738577 - DNA, 13 bp, C. elegans
ttgtgaaattaat

SEQ ID NO: 738578 - DNA, 13 bp, C. elegans
ttgtgaaattgta

SEQ ID NO: 738579 - DNA, 13 bp, C. elegans
ttgtgaagaaaaa

SEQ ID NO: 738580 - DNA, 13 bp, C. elegans
ttgtgaagaaatg

SEQ ID NO: 738581 - DNA, 13 bp, C. elegans
ttgtgaagaaatt

SEQ ID NO: 738582 - DNA, 13 bp, C. elegans
ttgtgaagatttt

SEQ ID NO: 738583 - DNA, 13 bp, C. elegans
ttgtgaataactt

SEQ ID NO: 738584 - DNA, 13 bp, C. elegans
ttgtgaatattct

SEQ ID NO: 738585 - DNA, 13 bp, C. elegans
ttgtgaattaaaa

SEQ ID NO: 738586 - DNA, 13 bp, C. elegans
ttgtgaatttctt

SEQ ID NO: 738587 - DNA, 13 bp, C. elegans
ttgtgaattttga

SEQ ID NO: 738588 - DNA, 13 bp, C. elegans
ttgtgacaaattt

SEQ ID NO: 738589 - DNA, 13 bp, C. elegans
ttgtgacaatttt

SEQ ID NO: 738590 - DNA, 13 bp, C. elegans
ttgtgacctctct

SEQ ID NO: 738591 - DNA, 13 bp, C. elegans
ttgtgacgtcaca

SEQ ID NO: 738592 - DNA, 13 bp, C. elegans
ttgtgacgtcagc

SEQ ID NO: 738593 - DNA, 13 bp, C. elegans
ttgtgacttttta

SEQ ID NO: 738594 - DNA, 13 bp, C. elegans
ttgtgagttttga

SEQ ID NO: 738595 - DNA, 13 bp, C. elegans
ttgtgatctacaa

SEQ ID NO: 738596 - DNA, 13 bp, C. elegans
ttgtgatgaaaat

SEQ ID NO: 738597 - DNA, 13 bp, C. elegans
ttgtgatgaattt

SEQ ID NO: 738598 - DNA, 13 bp, C. elegans
ttgtgatgtttca

SEQ ID NO: 738599 - DNA, 13 bp, C. elegans
ttgtgattcattt

SEQ ID NO: 738600 - DNA, 13 bp, C. elegans
ttgtgattgaaaa

SEQ ID NO: 738601 - DNA, 13 bp, C. elegans
ttgtgatttcatt

SEQ ID NO: 738602 - DNA, 13 bp, C. elegans
ttgtgattttcaa

SEQ ID NO: 738603 - DNA, 13 bp, C. elegans
ttgtgattttcca

SEQ ID NO: 738604 - DNA, 13 bp, C. elegans
ttgtgatttttac

SEQ ID NO: 738605 - DNA, 13 bp, C. elegans
ttgtgcaaaaaat

SEQ ID NO: 738606 - DNA, 13 bp, C. elegans
ttgtgcaaaaatc

SEQ ID NO: 738607 - DNA, 13 bp, C. elegans
ttgtgcaaaactt

SEQ ID NO: 738608 - DNA, 13 bp, C. elegans
ttgtgcaacattt

SEQ ID NO: 738609 - DNA, 13 bp, C. elegans
ttgtgcaagtttt

SEQ ID NO: 738610 - DNA, 13 bp, C. elegans
ttgtgcaatttgt

SEQ ID NO: 738611 - DNA, 13 bp, C. elegans
ttgtgcaattttt

SEQ ID NO: 738612 - DNA, 13 bp, C. elegans
ttgtgcagaaaat

SEQ ID NO: 738613 - DNA, 13 bp, C. elegans
ttgtgcatatttc

SEQ ID NO: 738614 - DNA, 13 bp, C. elegans
ttgtgccatttta

SEQ ID NO: 738615 - DNA, 13 bp, C. elegans
ttgtgcctacatg

SEQ ID NO: 738616 - DNA, 13 bp, C. elegans
ttgtgcctacgtg

SEQ ID NO: 738617 - DNA, 13 bp, C. elegans
ttgtgctcaattt

SEQ ID NO: 738618 - DNA, 13 bp, C. elegans
ttgtgctgaaaat

SEQ ID NO: 738619 - DNA, 13 bp, C. elegans
ttgtggaaaaata

SEQ ID NO: 738620 - DNA, 13 bp, C. elegans
ttgtggaaaatat

SEQ ID NO: 738621 - DNA, 13 bp, C. elegans
ttgtggaaaatta

SEQ ID NO: 738622 - DNA, 13 bp, C. elegans
ttgtggaaatatt

SEQ ID NO: 738623 - DNA, 13 bp, C. elegans
ttgtggaaatgtt

SEQ ID NO: 738624 - DNA, 13 bp, C. elegans
ttgtggaatgttt

SEQ ID NO: 738625 - DNA, 13 bp, C. elegans
ttgtggaatttta

SEQ ID NO: 738626 - DNA, 13 bp, C. elegans
ttgtggattttca

SEQ ID NO: 738627 - DNA, 13 bp, C. elegans
ttgtggcctaaaa

SEQ ID NO: 738628 - DNA, 13 bp, C. elegans
ttgtggtaaaaaa

SEQ ID NO: 738629 - DNA, 13 bp, C. elegans
ttgtggtctacaa

SEQ ID NO: 738630 - DNA, 13 bp, C. elegans
ttgtggtgaaaat

SEQ ID NO: 738631 - DNA, 13 bp, C. elegans
ttgtggtgaattt

SEQ ID NO: 738632 - DNA, 13 bp, C. elegans
ttgtggttcaatc

SEQ ID NO: 738633 - DNA, 13 bp, C. elegans
ttgtgtaataaat

SEQ ID NO: 738634 - DNA, 13 bp, C. elegans
ttgtgtaatgtac

SEQ ID NO: 738635 - DNA, 13 bp, C. elegans
ttgtgtcaaaaat

SEQ ID NO: 738636 - DNA, 13 bp, C. elegans
ttgtgtcaaaatg

SEQ ID NO: 738637 - DNA, 13 bp, C. elegans
ttgtgtcaaaatt

SEQ ID NO: 738638 - DNA, 13 bp, C. elegans
ttgtgtccatttt

SEQ ID NO: 738639 - DNA, 13 bp, C. elegans
ttgtgtgaatagt

SEQ ID NO: 738640 - DNA, 13 bp, C. elegans
ttgtgtgttttca

SEQ ID NO: 738641 - DNA, 13 bp, C. elegans
ttgtgttcaaaaa

SEQ ID NO: 738642 - DNA, 13 bp, C. elegans
ttgtgttgcaaaa

SEQ ID NO: 738643 - DNA, 13 bp, C. elegans
ttgtgtttcaaaa

SEQ ID NO: 738644 - DNA, 13 bp, C. elegans
ttgtgtttgaaaa

SEQ ID NO: 738645 - DNA, 13 bp, C. elegans
ttgtgttttaaaa

SEQ ID NO: 738646 - DNA, 13 bp, C. elegans
ttgtgttttagtc

SEQ ID NO: 738647 - DNA, 13 bp, C. elegans
ttgtgttttcaga

SEQ ID NO: 738648 - DNA, 13 bp, C. elegans
ttgtgttttctag

SEQ ID NO: 738649 - DNA, 13 bp, C. elegans
ttgtgttttggaa

SEQ ID NO: 738650 - DNA, 13 bp, C. elegans
ttgtgtttttcac

SEQ ID NO: 738651 - DNA, 13 bp, C. elegans
ttgttaaaaaatg

SEQ ID NO: 738652 - DNA, 13 bp, C. elegans
ttgttaaaaacaa

SEQ ID NO: 738653 - DNA, 13 bp, C. elegans
ttgttaaaaagta

SEQ ID NO: 738654 - DNA, 13 bp, C. elegans
ttgttaaagtaaa

SEQ ID NO: 738655 - DNA, 13 bp, C. elegans
ttgttaaatattc

SEQ ID NO: 738656 - DNA, 13 bp, C. elegans
ttgttaaatgaaa

SEQ ID NO: 738657 - DNA, 13 bp, C. elegans
ttgttaacctttt

SEQ ID NO: 738658 - DNA, 13 bp, C. elegans
ttgttaatcaatt

SEQ ID NO: 738659 - DNA, 13 bp, C. elegans
ttgttaatttcaa

SEQ ID NO: 738660 - DNA, 13 bp, C. elegans
ttgttaatttgaa

SEQ ID NO: 738661 - DNA, 13 bp, C. elegans
ttgttaattttca

SEQ ID NO: 738662 - DNA, 13 bp, C. elegans
ttgttacaaaatt

SEQ ID NO: 738663 - DNA, 13 bp, C. elegans
ttgttacaagaaa

SEQ ID NO: 738664 - DNA, 13 bp, C. elegans
ttgttacgaaaaa

SEQ ID NO: 738665 - DNA, 13 bp, C. elegans
ttgttagaaaatg

SEQ ID NO: 738666 - DNA, 13 bp, C. elegans
ttgttagattttc

SEQ ID NO: 738667 - DNA, 13 bp, C. elegans
ttgttagttggaa

SEQ ID NO: 738668 - DNA, 13 bp, C. elegans
ttgttatctgaaa

SEQ ID NO: 738669 - DNA, 13 bp, C. elegans
ttgttattctcaa

SEQ ID NO: 738670 - DNA, 13 bp, C. elegans
ttgttattttaca

SEQ ID NO: 738671 - DNA, 13 bp, C. elegans
ttgttattttcca

SEQ ID NO: 738672 - DNA, 13 bp, C. elegans
ttgttcaaaaaat

SEQ ID NO: 738673 - DNA, 13 bp, C. elegans
ttgttcaaaaagt

SEQ ID NO: 738674 - DNA, 13 bp, C. elegans
ttgttcaaaacaa

SEQ ID NO: 738675 - DNA, 13 bp, C. elegans
ttgttcaaaacat

SEQ ID NO: 738676 - DNA, 13 bp, C. elegans
ttgttcaaaagtt

SEQ ID NO: 738677 - DNA, 13 bp, C. elegans
ttgttcaaaattc

SEQ ID NO: 738678 - DNA, 13 bp, C. elegans
ttgttcaaaattt

SEQ ID NO: 738679 - DNA, 13 bp, C. elegans
ttgttcaaacacg

SEQ ID NO: 738680 - DNA, 13 bp, C. elegans
ttgttcaaatata

SEQ ID NO: 738681 - DNA, 13 bp, C. elegans
ttgttcaaatatt

SEQ ID NO: 738682 - DNA, 13 bp, C. elegans
ttgttcaaattga

SEQ ID NO: 738683 - DNA, 13 bp, C. elegans
ttgttcaacaaaa

SEQ ID NO: 738684 - DNA, 13 bp, C. elegans
ttgttcaacattt

SEQ ID NO: 738685 - DNA, 13 bp, C. elegans
ttgttcaactttc

SEQ ID NO: 738686 - DNA, 13 bp, C. elegans
ttgttcaagaaat

SEQ ID NO: 738687 - DNA, 13 bp, C. elegans
ttgttcaagttta

SEQ ID NO: 738688 - DNA, 13 bp, C. elegans
ttgttcaatattt

SEQ ID NO: 738689 - DNA, 13 bp, C. elegans
ttgttcaatcaaa

SEQ ID NO: 738690 - DNA, 13 bp, C. elegans
ttgttcaattcaa

SEQ ID NO: 738691 - DNA, 13 bp, C. elegans
ttgttcaatttaa

SEQ ID NO: 738692 - DNA, 13 bp, C. elegans
ttgttcaatttca

SEQ ID NO: 738693 - DNA, 13 bp, C. elegans
ttgttcaattttg

SEQ ID NO: 738694 - DNA, 13 bp, C. elegans
ttgttcacaatta

SEQ ID NO: 738695 - DNA, 13 bp, C. elegans
ttgttcacatttt

SEQ ID NO: 738696 - DNA, 13 bp, C. elegans
ttgttcactgtta

SEQ ID NO: 738697 - DNA, 13 bp, C. elegans
ttgttcactgttt

SEQ ID NO: 738698 - DNA, 13 bp, C. elegans
ttgttcagaaaaa

SEQ ID NO: 738699 - DNA, 13 bp, C. elegans
ttgttcagtattt

SEQ ID NO: 738700 - DNA, 13 bp, C. elegans
ttgttcagtgaaa

SEQ ID NO: 738701 - DNA, 13 bp, C. elegans
ttgttcagttttc

SEQ ID NO: 738702 - DNA, 13 bp, C. elegans
ttgttcagttttg

SEQ ID NO: 738703 - DNA, 13 bp, C. elegans
ttgttcataaatt

SEQ ID NO: 738704 - DNA, 13 bp, C. elegans
ttgttcataattt

SEQ ID NO: 738705 - DNA, 13 bp, C. elegans
ttgttcatagaaa

SEQ ID NO: 738706 - DNA, 13 bp, C. elegans
ttgttcattaaaa

SEQ ID NO: 738707 - DNA, 13 bp, C. elegans
ttgttcattcatt

SEQ ID NO: 738708 - DNA, 13 bp, C. elegans
ttgttcattgaac

SEQ ID NO: 738709 - DNA, 13 bp, C. elegans
ttgttccaaaaaa

SEQ ID NO: 738710 - DNA, 13 bp, C. elegans
ttgttccaaaaac

SEQ ID NO: 738711 - DNA, 13 bp, C. elegans
ttgttccaataaa

SEQ ID NO: 738712 - DNA, 13 bp, C. elegans
ttgttccaatttc

SEQ ID NO: 738713 - DNA, 13 bp, C. elegans
ttgttccagtttt

SEQ ID NO: 738714 - DNA, 13 bp, C. elegans
ttgttcccaaaaa

SEQ ID NO: 738715 - DNA, 13 bp, C. elegans
ttgttcgaaaagt

SEQ ID NO: 738716 - DNA, 14 bp, C. elegans
ttgttcggtggagc

SEQ ID NO: 738717 - DNA, 13 bp, C. elegans
ttgttctaaaaag

SEQ ID NO: 738718 - DNA, 13 bp, C. elegans
ttgttctaaaatt

SEQ ID NO: 738719 - DNA, 13 bp, C. elegans
ttgttctacattt

SEQ ID NO: 738720 - DNA, 13 bp, C. elegans
ttgttctagaaat

SEQ ID NO: 738721 - DNA, 13 bp, C. elegans
ttgttctatctga

SEQ ID NO: 738722 - DNA, 13 bp, C. elegans
ttgttctattcaa

SEQ ID NO: 738723 - DNA, 13 bp, C. elegans
ttgttctcgaaaa

SEQ ID NO: 738724 - DNA, 13 bp, C. elegans
ttgttctcgattt

SEQ ID NO: 738725 - DNA, 13 bp, C. elegans
ttgttctctgaaa

SEQ ID NO: 738726 - DNA, 13 bp, C. elegans
ttgttctgtaaaa

SEQ ID NO: 738727 - DNA, 13 bp, C. elegans
ttgttcttcaaaa

SEQ ID NO: 738728 - DNA, 13 bp, C. elegans
ttgttcttgaaat

SEQ ID NO: 738729 - DNA, 13 bp, C. elegans
ttgttctttgaaa

SEQ ID NO: 738730 - DNA, 13 bp, C. elegans
ttgttgaaaaaac

SEQ ID NO: 738731 - DNA, 13 bp, C. elegans
ttgttgaaaaaat

SEQ ID NO: 738732 - DNA, 13 bp, C. elegans
ttgttgaaaaact

SEQ ID NO: 738733 - DNA, 13 bp, C. elegans
ttgttgaaaaatc

SEQ ID NO: 738734 - DNA, 13 bp, C. elegans
ttgttgaaaacaa

SEQ ID NO: 738735 - DNA, 13 bp, C. elegans
ttgttgaaaacca

SEQ ID NO: 738736 - DNA, 13 bp, C. elegans
ttgttgaaaactt

SEQ ID NO: 738737 - DNA, 13 bp, C. elegans
ttgttgaaaagat

SEQ ID NO: 738738 - DNA, 13 bp, C. elegans
ttgttgaaaatca

SEQ ID NO: 738739 - DNA, 13 bp, C. elegans
ttgttgaaaatgg

SEQ ID NO: 738740 - DNA, 13 bp, C. elegans
ttgttgaaacaat

SEQ ID NO: 738741 - DNA, 13 bp, C. elegans
ttgttgaaacttt

SEQ ID NO: 738742 - DNA, 13 bp, C. elegans
ttgttgaaagttg

SEQ ID NO: 738743 - DNA, 13 bp, C. elegans
ttgttgaaataat

SEQ ID NO: 738744 - DNA, 13 bp, C. elegans
ttgttgaaatata

SEQ ID NO: 738745 - DNA, 13 bp, C. elegans
ttgttgaaatcct

SEQ ID NO: 738746 - DNA, 13 bp, C. elegans
ttgttgaatagtg

SEQ ID NO: 738747 - DNA, 13 bp, C. elegans
ttgttgaatcttt

SEQ ID NO: 738748 - DNA, 13 bp, C. elegans
ttgttgaatgaaa

SEQ ID NO: 738749 - DNA, 13 bp, C. elegans
ttgttgaatgatt

SEQ ID NO: 738750 - DNA, 13 bp, C. elegans
ttgttgaattata

SEQ ID NO: 738751 - DNA, 13 bp, C. elegans
ttgttgacaataa

SEQ ID NO: 738752 - DNA, 13 bp, C. elegans
ttgttgacttttc

SEQ ID NO: 738753 - DNA, 13 bp, C. elegans
ttgttgagaattt

SEQ ID NO: 738754 - DNA, 13 bp, C. elegans
ttgttgatatata

SEQ ID NO: 738755 - DNA, 13 bp, C. elegans
ttgttgatgaaat

SEQ ID NO: 738756 - DNA, 13 bp, C. elegans
ttgttgattcaaa

SEQ ID NO: 738757 - DNA, 13 bp, C. elegans
ttgttgattttcc

SEQ ID NO: 738758 - DNA, 13 bp, C. elegans
ttgttgcaaagtt

SEQ ID NO: 738759 - DNA, 13 bp, C. elegans
ttgttgcaatttc

SEQ ID NO: 738760 - DNA, 13 bp, C. elegans
ttgttgcagaaaa

SEQ ID NO: 738761 - DNA, 13 bp, C. elegans
ttgttgcatattg

SEQ ID NO: 738762 - DNA, 13 bp, C. elegans
ttgttgcattttc

SEQ ID NO: 738763 - DNA, 13 bp, C. elegans
ttgttgccagaaa

SEQ ID NO: 738764 - DNA, 13 bp, C. elegans
ttgttgctgaaat

SEQ ID NO: 738765 - DNA, 13 bp, C. elegans
ttgttgctgctcc

SEQ ID NO: 738766 - DNA, 13 bp, C. elegans
ttgttgcttaaaa

SEQ ID NO: 738767 - DNA, 13 bp, C. elegans
ttgttggaaaata

SEQ ID NO: 738768 - DNA, 13 bp, C. elegans
ttgttggaaaatt

SEQ ID NO: 738769 - DNA, 13 bp, C. elegans
ttgttggaaagtt

SEQ ID NO: 738770 - DNA, 13 bp, C. elegans
ttgttggaattga

SEQ ID NO: 738771 - DNA, 13 bp, C. elegans
ttgttggcagaaa

SEQ ID NO: 738772 - DNA, 13 bp, C. elegans
ttgttgtaaaatt

SEQ ID NO: 738773 - DNA, 13 bp, C. elegans
ttgttgtaataaa

SEQ ID NO: 738774 - DNA, 13 bp, C. elegans
ttgttgttaaaat

SEQ ID NO: 738775 - DNA, 13 bp, C. elegans
ttgttgttaaact

SEQ ID NO: 738776 - DNA, 13 bp, C. elegans
ttgttgttaagaa

SEQ ID NO: 738777 - DNA, 13 bp, C. elegans
ttgttgttcactt

SEQ ID NO: 738778 - DNA, 13 bp, C. elegans
ttgttgttgtaaa

SEQ ID NO: 738779 - DNA, 13 bp, C. elegans
ttgttgttgtgaa

SEQ ID NO: 738780 - DNA, 13 bp, C. elegans
ttgtttaaagttg

SEQ ID NO: 738781 - DNA, 13 bp, C. elegans
ttgtttaaatact

SEQ ID NO: 738782 - DNA, 13 bp, C. elegans
ttgtttaaatgat

SEQ ID NO: 738783 - DNA, 13 bp, C. elegans
ttgtttacaaatt

SEQ ID NO: 738784 - DNA, 13 bp, C. elegans
ttgtttacagaaa

SEQ ID NO: 738785 - DNA, 13 bp, C. elegans
ttgtttacagttt

SEQ ID NO: 738786 - DNA, 13 bp, C. elegans
ttgtttatctgaa

SEQ ID NO: 738787 - DNA, 13 bp, C. elegans
ttgtttattagaa

SEQ ID NO: 738788 - DNA, 13 bp, C. elegans
ttgtttattcaat

SEQ ID NO: 738789 - DNA, 13 bp, C. elegans
ttgtttcaaaaaa

SEQ ID NO: 738790 - DNA, 13 bp, C. elegans
ttgtttcaaaaac

SEQ ID NO: 738791 - DNA, 13 bp, C. elegans
ttgtttcaaaact

SEQ ID NO: 738792 - DNA, 13 bp, C. elegans
ttgtttcaaattg

SEQ ID NO: 738793 - DNA, 13 bp, C. elegans
ttgtttcaaattt

SEQ ID NO: 738794 - DNA, 13 bp, C. elegans
ttgtttcaacttt

SEQ ID NO: 738795 - DNA, 13 bp, C. elegans
ttgtttcaataaa

SEQ ID NO: 738796 - DNA, 13 bp, C. elegans
ttgtttcaatgat

SEQ ID NO: 738797 - DNA, 13 bp, C. elegans
ttgtttcaatgct

SEQ ID NO: 738798 - DNA, 13 bp, C. elegans
ttgtttcaatgtt

SEQ ID NO: 738799 - DNA, 13 bp, C. elegans
ttgtttcaattat

SEQ ID NO: 738800 - DNA, 13 bp, C. elegans
ttgtttcaattta

SEQ ID NO: 738801 - DNA, 13 bp, C. elegans
ttgtttcataaat

SEQ ID NO: 738802 - DNA, 13 bp, C. elegans
ttgtttcatactt

SEQ ID NO: 738803 - DNA, 13 bp, C. elegans
ttgtttcattcaa

SEQ ID NO: 738804 - DNA, 13 bp, C. elegans
ttgtttcattgaa

SEQ ID NO: 738805 - DNA, 13 bp, C. elegans
ttgtttcatttca

SEQ ID NO: 738806 - DNA, 13 bp, C. elegans
ttgtttccaattt

SEQ ID NO: 738807 - DNA, 13 bp, C. elegans
ttgtttccatgat

SEQ ID NO: 738808 - DNA, 13 bp, C. elegans
ttgtttccattcc

SEQ ID NO: 738809 - DNA, 13 bp, C. elegans
ttgtttcctaaaa

SEQ ID NO: 738810 - DNA, 13 bp, C. elegans
ttgtttcgaaaaa

SEQ ID NO: 738811 - DNA, 13 bp, C. elegans
ttgtttcgaaata

SEQ ID NO: 738812 - DNA, 13 bp, C. elegans
ttgtttcgaaatt

SEQ ID NO: 738813 - DNA, 13 bp, C. elegans
ttgtttcgttcaa

SEQ ID NO: 738814 - DNA, 13 bp, C. elegans
ttgtttcttctca

SEQ ID NO: 738815 - DNA, 13 bp, C. elegans
ttgtttgaaaaat

SEQ ID NO: 738816 - DNA, 13 bp, C. elegans
ttgtttgaaaatg

SEQ ID NO: 738817 - DNA, 13 bp, C. elegans
ttgtttgaaacaa

SEQ ID NO: 738818 - DNA, 13 bp, C. elegans
ttgtttgaaatgt

SEQ ID NO: 738819 - DNA, 13 bp, C. elegans
ttgtttgaaatta

SEQ ID NO: 738820 - DNA, 13 bp, C. elegans
ttgtttgaattaa

SEQ ID NO: 738821 - DNA, 13 bp, C. elegans
ttgtttgataata

SEQ ID NO: 738822 - DNA, 13 bp, C. elegans
ttgtttgcaaaaa

SEQ ID NO: 738823 - DNA, 13 bp, C. elegans
ttgtttgcagttt

SEQ ID NO: 738824 - DNA, 13 bp, C. elegans
ttgtttggaaaca

SEQ ID NO: 738825 - DNA, 13 bp, C. elegans
ttgtttgtagaaa

SEQ ID NO: 738826 - DNA, 13 bp, C. elegans
ttgtttgtgaaaa

SEQ ID NO: 738827 - DNA, 13 bp, C. elegans
ttgtttgttcaaa

SEQ ID NO: 738828 - DNA, 13 bp, C. elegans
ttgtttgttgaaa

SEQ ID NO: 738829 - DNA, 13 bp, C. elegans
ttgtttgtttcaa

SEQ ID NO: 738830 - DNA, 13 bp, C. elegans
ttgttttaaaaac

SEQ ID NO: 738831 - DNA, 13 bp, C. elegans
ttgttttaaaaca

SEQ ID NO: 738832 - DNA, 13 bp, C. elegans
ttgttttaaactt

SEQ ID NO: 738833 - DNA, 13 bp, C. elegans
ttgttttaagaaa

SEQ ID NO: 738834 - DNA, 13 bp, C. elegans
ttgttttaatcaa

SEQ ID NO: 738835 - DNA, 13 bp, C. elegans
ttgttttagaaaa

SEQ ID NO: 738836 - DNA, 13 bp, C. elegans
ttgttttatcaaa

SEQ ID NO: 738837 - DNA, 13 bp, C. elegans
ttgttttatgaaa

SEQ ID NO: 738838 - DNA, 13 bp, C. elegans
ttgttttcaaaca

SEQ ID NO: 738839 - DNA, 13 bp, C. elegans
ttgttttcaatga

SEQ ID NO: 738840 - DNA, 13 bp, C. elegans
ttgttttcaatta

SEQ ID NO: 738841 - DNA, 13 bp, C. elegans
ttgttttcagaaa

SEQ ID NO: 738842 - DNA, 13 bp, C. elegans
ttgttttcaggaa

SEQ ID NO: 738843 - DNA, 13 bp, C. elegans
ttgttttcataaa

SEQ ID NO: 738844 - DNA, 13 bp, C. elegans
ttgttttccaaaa

SEQ ID NO: 738845 - DNA, 13 bp, C. elegans
ttgttttccgaaa

SEQ ID NO: 738846 - DNA, 13 bp, C. elegans
ttgttttcgtaaa

SEQ ID NO: 738847 - DNA, 13 bp, C. elegans
ttgttttctaata

SEQ ID NO: 738848 - DNA, 13 bp, C. elegans
ttgttttctaatg

SEQ ID NO: 738849 - DNA, 13 bp, C. elegans
ttgttttctagta

SEQ ID NO: 738850 - DNA, 13 bp, C. elegans
ttgttttctcaaa

SEQ ID NO: 738851 - DNA, 13 bp, C. elegans
ttgttttctctga

SEQ ID NO: 738852 - DNA, 13 bp, C. elegans
ttgttttctgaaa

SEQ ID NO: 738853 - DNA, 13 bp, C. elegans
ttgttttctgtaa

SEQ ID NO: 738854 - DNA, 13 bp, C. elegans
ttgttttctgtga

SEQ ID NO: 738855 - DNA, 13 bp, C. elegans
ttgttttcttaga

SEQ ID NO: 738856 - DNA, 13 bp, C. elegans
ttgttttgaaaat

SEQ ID NO: 738857 - DNA, 13 bp, C. elegans
ttgttttgaaata

SEQ ID NO: 738858 - DNA, 13 bp, C. elegans
ttgttttgacaat

SEQ ID NO: 738859 - DNA, 13 bp, C. elegans
ttgttttgagaaa

SEQ ID NO: 738860 - DNA, 13 bp, C. elegans
ttgttttgcaaaa

SEQ ID NO: 738861 - DNA, 13 bp, C. elegans
ttgttttggaaaa

SEQ ID NO: 738862 - DNA, 13 bp, C. elegans
ttgttttggaaat

SEQ ID NO: 738863 - DNA, 13 bp, C. elegans
ttgttttggtaaa

SEQ ID NO: 738864 - DNA, 13 bp, C. elegans
ttgttttgtaaaa

SEQ ID NO: 738865 - DNA, 13 bp, C. elegans
ttgttttgtacaa

SEQ ID NO: 738866 - DNA, 13 bp, C. elegans
ttgttttgttcaa

SEQ ID NO: 738867 - DNA, 13 bp, C. elegans
ttgtttttaacat

SEQ ID NO: 738868 - DNA, 13 bp, C. elegans
ttgtttttatcaa

SEQ ID NO: 738869 - DNA, 13 bp, C. elegans
ttgtttttatcga

SEQ ID NO: 738870 - DNA, 13 bp, C. elegans
ttgtttttcatca

SEQ ID NO: 738871 - DNA, 13 bp, C. elegans
ttgtttttcgaaa

SEQ ID NO: 738872 - DNA, 14 bp, C. elegans
ttgtttttgaaaaa

SEQ ID NO: 738873 - DNA, 13 bp, C. elegans
ttgtttttgaatc

SEQ ID NO: 738874 - DNA, 13 bp, C. elegans
ttgtttttgacaa

SEQ ID NO: 738875 - DNA, 13 bp, C. elegans
ttgtttttgcaaa

SEQ ID NO: 738876 - DNA, 13 bp, C. elegans
ttgtttttgtaca

SEQ ID NO: 738877 - DNA, 13 bp, C. elegans
ttgttttttaaac

SEQ ID NO: 738878 - DNA, 13 bp, C. elegans
ttgttttttcaaa

SEQ ID NO: 738879 - DNA, 13 bp, C. elegans
ttgttttttcaac

SEQ ID NO: 738880 - DNA, 13 bp, C. elegans
ttgttttttcaag

SEQ ID NO: 738881 - DNA, 13 bp, C. elegans
tttaaaaaaaacg

SEQ ID NO: 738882 - DNA, 13 bp, C. elegans
tttaaaaaatcag

SEQ ID NO: 738883 - DNA, 13 bp, C. elegans
tttaaaaaatctg

SEQ ID NO: 738884 - DNA, 13 bp, C. elegans
tttaaaaaatgag

SEQ ID NO: 738885 - DNA, 13 bp, C. elegans
tttaaaaaatgca

SEQ ID NO: 738886 - DNA, 13 bp, C. elegans
tttaaaaactcaa

SEQ ID NO: 738887 - DNA, 13 bp, C. elegans
tttaaaaactcac

SEQ ID NO: 738888 - DNA, 13 bp, C. elegans
tttaaaaagtact

SEQ ID NO: 738889 - DNA, 13 bp, C. elegans
tttaaaaagtcga

SEQ ID NO: 738890 - DNA, 13 bp, C. elegans
tttaaaaagtgga

SEQ ID NO: 738891 - DNA, 13 bp, C. elegans
tttaaaaagtgtt

SEQ ID NO: 738892 - DNA, 13 bp, C. elegans
tttaaaaatcagc

SEQ ID NO: 738893 - DNA, 13 bp, C. elegans
tttaaaaatccaa

SEQ ID NO: 738894 - DNA, 13 bp, C. elegans
tttaaaaatctca

SEQ ID NO: 738895 - DNA, 13 bp, C. elegans
tttaaaaatgaag

SEQ ID NO: 738896 - DNA, 13 bp, C. elegans
tttaaaaatgttc

SEQ ID NO: 738897 - DNA, 13 bp, C. elegans
tttaaaaattcag

SEQ ID NO: 738898 - DNA, 13 bp, C. elegans
tttaaaaattccg

SEQ ID NO: 738899 - DNA, 13 bp, C. elegans
tttaaaaattgct

SEQ ID NO: 738900 - DNA, 13 bp, C. elegans
tttaaaaattggg

SEQ ID NO: 738901 - DNA, 13 bp, C. elegans
tttaaaaattgtg

SEQ ID NO: 738902 - DNA, 13 bp, C. elegans
tttaaaaatttgc

SEQ ID NO: 738903 - DNA, 13 bp, C. elegans
tttaaaacctaat

SEQ ID NO: 738904 - DNA, 13 bp, C. elegans
tttaaaacggttt

SEQ ID NO: 738905 - DNA, 13 bp, C. elegans
tttaaaacgtttt

SEQ ID NO: 738906 - DNA, 13 bp, C. elegans
tttaaaactaaac

SEQ ID NO: 738907 - DNA, 13 bp, C. elegans
tttaaaactagtt

SEQ ID NO: 738908 - DNA, 13 bp, C. elegans
tttaaaactcaat

SEQ ID NO: 738909 - DNA, 13 bp, C. elegans
tttaaaactgaaa

SEQ ID NO: 738910 - DNA, 13 bp, C. elegans
tttaaaactggtg

SEQ ID NO: 738911 - DNA, 13 bp, C. elegans
tttaaaacttaac

SEQ ID NO: 738912 - DNA, 13 bp, C. elegans
tttaaaacttcca

SEQ ID NO: 738913 - DNA, 13 bp, C. elegans
tttaaaacttctc

SEQ ID NO: 738914 - DNA, 13 bp, C. elegans
tttaaaacttgaa

SEQ ID NO: 738915 - DNA, 13 bp, C. elegans
tttaaaacttgtt

SEQ ID NO: 738916 - DNA, 13 bp, C. elegans
tttaaaactttct

SEQ ID NO: 738917 - DNA, 13 bp, C. elegans
tttaaaagaagtt

SEQ ID NO: 738918 - DNA, 13 bp, C. elegans
tttaaaagaatga

SEQ ID NO: 738919 - DNA, 13 bp, C. elegans
tttaaaagctttt

SEQ ID NO: 738920 - DNA, 13 bp, C. elegans
tttaaaagtacaa

SEQ ID NO: 738921 - DNA, 13 bp, C. elegans
tttaaaagtattc

SEQ ID NO: 738922 - DNA, 13 bp, C. elegans
tttaaaagtcatt

SEQ ID NO: 738923 - DNA, 13 bp, C. elegans
tttaaaagttgtt

SEQ ID NO: 738924 - DNA, 13 bp, C. elegans
tttaaaagtttct

SEQ ID NO: 738925 - DNA, 13 bp, C. elegans
tttaaaatcttca

SEQ ID NO: 738926 - DNA, 13 bp, C. elegans
tttaaaatgaaac

SEQ ID NO: 738927 - DNA, 13 bp, C. elegans
tttaaaatgtttg

SEQ ID NO: 738928 - DNA, 13 bp, C. elegans
tttaaaattactc

SEQ ID NO: 738929 - DNA, 13 bp, C. elegans
tttaaaattcccg

SEQ ID NO: 738930 - DNA, 13 bp, C. elegans
tttaaaattccgg

SEQ ID NO: 738931 - DNA, 13 bp, C. elegans
tttaaaattctca

SEQ ID NO: 738932 - DNA, 13 bp, C. elegans
tttaaaattgctt

SEQ ID NO: 738933 - DNA, 13 bp, C. elegans
tttaaaattgttc

SEQ ID NO: 738934 - DNA, 13 bp, C. elegans
tttaaaatttcac

SEQ ID NO: 738935 - DNA, 13 bp, C. elegans
tttaaaatttcag

SEQ ID NO: 738936 - DNA, 13 bp, C. elegans
tttaaaatttccg

SEQ ID NO: 738937 - DNA, 13 bp, C. elegans
tttaaaatttggt

SEQ ID NO: 738938 - DNA, 13 bp, C. elegans
tttaaaattttgg

SEQ ID NO: 738939 - DNA, 13 bp, C. elegans
tttaaacaaaatc

SEQ ID NO: 738940 - DNA, 13 bp, C. elegans
tttaaacaaagtt

SEQ ID NO: 738941 - DNA, 13 bp, C. elegans
tttaaacaacagt

SEQ ID NO: 738942 - DNA, 13 bp, C. elegans
tttaaacaattgt

SEQ ID NO: 738943 - DNA, 13 bp, C. elegans
tttaaacacaaat

SEQ ID NO: 738944 - DNA, 13 bp, C. elegans
tttaaacatgttt

SEQ ID NO: 738945 - DNA, 13 bp, C. elegans
tttaaacattcat

SEQ ID NO: 738946 - DNA, 13 bp, C. elegans
tttaaacattgaa

SEQ ID NO: 738947 - DNA, 13 bp, C. elegans
tttaaacatttgt

SEQ ID NO: 738948 - DNA, 13 bp, C. elegans
tttaaaccaaaat

SEQ ID NO: 738949 - DNA, 13 bp, C. elegans
tttaaaccaattt

SEQ ID NO: 738950 - DNA, 13 bp, C. elegans
tttaaaccggaaa

SEQ ID NO: 738951 - DNA, 13 bp, C. elegans
tttaaacctattt

SEQ ID NO: 738952 - DNA, 13 bp, C. elegans
tttaaacgaaaaa

SEQ ID NO: 738953 - DNA, 13 bp, C. elegans
tttaaacgtttat

SEQ ID NO: 738954 - DNA, 13 bp, C. elegans
tttaaacgttttt

SEQ ID NO: 738955 - DNA, 13 bp, C. elegans
tttaaactatcaa

SEQ ID NO: 738956 - DNA, 13 bp, C. elegans
tttaaactattca

SEQ ID NO: 738957 - DNA, 13 bp, C. elegans
tttaaactcaaaa

SEQ ID NO: 738958 - DNA, 13 bp, C. elegans
tttaaactcagaa

SEQ ID NO: 738959 - DNA, 13 bp, C. elegans
tttaaactcattt

SEQ ID NO: 738960 - DNA, 13 bp, C. elegans
tttaaactgaaaa

SEQ ID NO: 738961 - DNA, 14 bp, C. elegans
tttaaactgagaat

SEQ ID NO: 738962 - DNA, 13 bp, C. elegans
tttaaactggaaa

SEQ ID NO: 738963 - DNA, 13 bp, C. elegans
tttaaactgtaaa

SEQ ID NO: 738964 - DNA, 13 bp, C. elegans
tttaaacttcatt

SEQ ID NO: 738965 - DNA, 13 bp, C. elegans
tttaaacttgaat

SEQ ID NO: 738966 - DNA, 13 bp, C. elegans
tttaaacttgatt

SEQ ID NO: 738967 - DNA, 13 bp, C. elegans
tttaaactttcaa

SEQ ID NO: 738968 - DNA, 13 bp, C. elegans
tttaaactttcgt

SEQ ID NO: 738969 - DNA, 13 bp, C. elegans
tttaaagaaaaca

SEQ ID NO: 738970 - DNA, 13 bp, C. elegans
tttaaagaaaacc

SEQ ID NO: 738971 - DNA, 13 bp, C. elegans
tttaaagaaaagt

SEQ ID NO: 738972 - DNA, 13 bp, C. elegans
tttaaagaaaatc

SEQ ID NO: 738973 - DNA, 13 bp, C. elegans
tttaaagaaaatg

SEQ ID NO: 738974 - DNA, 13 bp, C. elegans
tttaaagaaagtt

SEQ ID NO: 738975 - DNA, 13 bp, C. elegans
tttaaagaaatgt

SEQ ID NO: 738976 - DNA, 13 bp, C. elegans
tttaaagaacaat

SEQ ID NO: 738977 - DNA, 13 bp, C. elegans
tttaaagaatgtt

SEQ ID NO: 738978 - DNA, 13 bp, C. elegans
tttaaagaattac

SEQ ID NO: 738979 - DNA, 13 bp, C. elegans
tttaaagacattt

SEQ ID NO: 738980 - DNA, 13 bp, C. elegans
tttaaagatcttt

SEQ ID NO: 738981 - DNA, 13 bp, C. elegans
tttaaagatgtat

SEQ ID NO: 738982 - DNA, 13 bp, C. elegans
tttaaagcaaaaa

SEQ ID NO: 738983 - DNA, 13 bp, C. elegans
tttaaagcaattt

SEQ ID NO: 738984 - DNA, 13 bp, C. elegans
tttaaagcacaat

SEQ ID NO: 738985 - DNA, 13 bp, C. elegans
tttaaagcatttt

SEQ ID NO: 738986 - DNA, 13 bp, C. elegans
tttaaaggcgcat

SEQ ID NO: 738987 - DNA, 13 bp, C. elegans
tttaaagggacat

SEQ ID NO: 738988 - DNA, 13 bp, C. elegans
tttaaaggtattt

SEQ ID NO: 738989 - DNA, 13 bp, C. elegans
tttaaaggtttta

SEQ ID NO: 738990 - DNA, 13 bp, C. elegans
tttaaagtattca

SEQ ID NO: 738991 - DNA, 13 bp, C. elegans
tttaaagtcaaaa

SEQ ID NO: 738992 - DNA, 13 bp, C. elegans
tttaaagtccggg

SEQ ID NO: 738993 - DNA, 13 bp, C. elegans
tttaaagtctttt

SEQ ID NO: 738994 - DNA, 13 bp, C. elegans
tttaaagtgattt

SEQ ID NO: 738995 - DNA, 13 bp, C. elegans
tttaaagttatga

SEQ ID NO: 738996 - DNA, 13 bp, C. elegans
tttaaagttattc

SEQ ID NO: 738997 - DNA, 13 bp, C. elegans
tttaaagttctgt

SEQ ID NO: 738998 - DNA, 13 bp, C. elegans
tttaaagtttatg

SEQ ID NO: 738999 - DNA, 13 bp, C. elegans
tttaaagtttttc

SEQ ID NO: 739000 - DNA, 13 bp, C. elegans
tttaaatatgttc

SEQ ID NO: 739001 - DNA, 13 bp, C. elegans
tttaaatcaactt

SEQ ID NO: 739002 - DNA, 13 bp, C. elegans
tttaaatcacatt

SEQ ID NO: 739003 - DNA, 13 bp, C. elegans
tttaaatcagatt

SEQ ID NO: 739004 - DNA, 13 bp, C. elegans
tttaaatccaaat

SEQ ID NO: 739005 - DNA, 13 bp, C. elegans
tttaaatctatgt

SEQ ID NO: 739006 - DNA, 13 bp, C. elegans
tttaaatctgaaa

SEQ ID NO: 739007 - DNA, 13 bp, C. elegans
tttaaatctttca

SEQ ID NO: 739008 - DNA, 13 bp, C. elegans
tttaaatgaactt

SEQ ID NO: 739009 - DNA, 13 bp, C. elegans
tttaaatgatttc

SEQ ID NO: 739010 - DNA, 13 bp, C. elegans
tttaaatgcaatt

SEQ ID NO: 739011 - DNA, 13 bp, C. elegans
tttaaatgcattt

SEQ ID NO: 739012 - DNA, 13 bp, C. elegans
tttaaatggcaaa

SEQ ID NO: 739013 - DNA, 13 bp, C. elegans
tttaaatgtactt

SEQ ID NO: 739014 - DNA, 13 bp, C. elegans
tttaaatgtgtat

SEQ ID NO: 739015 - DNA, 13 bp, C. elegans
tttaaatgttcaa

SEQ ID NO: 739016 - DNA, 13 bp, C. elegans
tttaaatgtttca

SEQ ID NO: 739017 - DNA, 13 bp, C. elegans
tttaaatgttttc

SEQ ID NO: 739018 - DNA, 13 bp, C. elegans
tttaaattcaaac

SEQ ID NO: 739019 - DNA, 13 bp, C. elegans
tttaaattcggaa

SEQ ID NO: 739020 - DNA, 13 bp, C. elegans
tttaaattctaca

SEQ ID NO: 739021 - DNA, 13 bp, C. elegans
tttaaattctcat

SEQ ID NO: 739022 - DNA, 13 bp, C. elegans
tttaaattctcta

SEQ ID NO: 739023 - DNA, 13 bp, C. elegans
tttaaattctgtt

SEQ ID NO: 739024 - DNA, 13 bp, C. elegans
tttaaattgaaac

SEQ ID NO: 739025 - DNA, 13 bp, C. elegans
tttaaattgaaca

SEQ ID NO: 739026 - DNA, 13 bp, C. elegans
tttaaattggaat

SEQ ID NO: 739027 - DNA, 13 bp, C. elegans
tttaaattggtgg

SEQ ID NO: 739028 - DNA, 13 bp, C. elegans
tttaaatttcaac

SEQ ID NO: 739029 - DNA, 13 bp, C. elegans
tttaaatttcaca

SEQ ID NO: 739030 - DNA, 13 bp, C. elegans
tttaaatttcccg

SEQ ID NO: 739031 - DNA, 13 bp, C. elegans
tttaaatttccct

SEQ ID NO: 739032 - DNA, 13 bp, C. elegans
tttaaatttccga

SEQ ID NO: 739033 - DNA, 13 bp, C. elegans
tttaaatttgaac

SEQ ID NO: 739034 - DNA, 13 bp, C. elegans
tttaaatttgaag

SEQ ID NO: 739035 - DNA, 13 bp, C. elegans
tttaaatttgagt

SEQ ID NO: 739036 - DNA, 13 bp, C. elegans
tttaaatttgctt

SEQ ID NO: 739037 - DNA, 13 bp, C. elegans
tttaaatttgtca

SEQ ID NO: 739038 - DNA, 13 bp, C. elegans
tttaacaaatcaa

SEQ ID NO: 739039 - DNA, 13 bp, C. elegans
tttaacaacattt

SEQ ID NO: 739040 - DNA, 13 bp, C. elegans
tttaacaactttc

SEQ ID NO: 739041 - DNA, 13 bp, C. elegans
tttaacaactttt

SEQ ID NO: 739042 - DNA, 13 bp, C. elegans
tttaacaattatc

SEQ ID NO: 739043 - DNA, 13 bp, C. elegans
tttaacacatttt

SEQ ID NO: 739044 - DNA, 13 bp, C. elegans
tttaacacttttc

SEQ ID NO: 739045 - DNA, 13 bp, C. elegans
tttaacagaaaaa

SEQ ID NO: 739046 - DNA, 13 bp, C. elegans
tttaacagaaaat

SEQ ID NO: 739047 - DNA, 13 bp, C. elegans
tttaacatcaaaa

SEQ ID NO: 739048 - DNA, 13 bp, C. elegans
tttaacatgaaaa

SEQ ID NO: 739049 - DNA, 13 bp, C. elegans
tttaacatgtttc

SEQ ID NO: 739050 - DNA, 13 bp, C. elegans
tttaacattttca

SEQ ID NO: 739051 - DNA, 13 bp, C. elegans
tttaacattttgg

SEQ ID NO: 739052 - DNA, 13 bp, C. elegans
tttaacatttttg

SEQ ID NO: 739053 - DNA, 13 bp, C. elegans
tttaaccaaaatt

SEQ ID NO: 739054 - DNA, 13 bp, C. elegans
tttaaccattttc

SEQ ID NO: 739055 - DNA, 13 bp, C. elegans
tttaaccgaaaat

SEQ ID NO: 739056 - DNA, 13 bp, C. elegans
tttaacctatcaa

SEQ ID NO: 739057 - DNA, 13 bp, C. elegans
tttaacgaaaaag

SEQ ID NO: 739058 - DNA, 13 bp, C. elegans
tttaacgaatttt

SEQ ID NO: 739059 - DNA, 13 bp, C. elegans
tttaacgataaaa

SEQ ID NO: 739060 - DNA, 13 bp, C. elegans
tttaacgattttt

SEQ ID NO: 739061 - DNA, 13 bp, C. elegans
tttaacgctaaaa

SEQ ID NO: 739062 - DNA, 13 bp, C. elegans
tttaacgctgaaa

SEQ ID NO: 739063 - DNA, 13 bp, C. elegans
tttaacgtttaaa

SEQ ID NO: 739064 - DNA, 13 bp, C. elegans
tttaactaattgt

SEQ ID NO: 739065 - DNA, 13 bp, C. elegans
tttaactaatttc

SEQ ID NO: 739066 - DNA, 13 bp, C. elegans
tttaactatgaaa

SEQ ID NO: 739067 - DNA, 13 bp, C. elegans
tttaactattcaa

SEQ ID NO: 739068 - DNA, 13 bp, C. elegans
tttaactatttca

SEQ ID NO: 739069 - DNA, 13 bp, C. elegans
tttaactcaaaaa

SEQ ID NO: 739070 - DNA, 13 bp, C. elegans
tttaactctgaaa

SEQ ID NO: 739071 - DNA, 13 bp, C. elegans
tttaactgaaaat

SEQ ID NO: 739072 - DNA, 13 bp, C. elegans
tttaactggaaaa

SEQ ID NO: 739073 - DNA, 13 bp, C. elegans
tttaactggaaat

SEQ ID NO: 739074 - DNA, 13 bp, C. elegans
tttaactgtattt

SEQ ID NO: 739075 - DNA, 13 bp, C. elegans
tttaacttcagaa

SEQ ID NO: 739076 - DNA, 13 bp, C. elegans
tttaacttctaaa

SEQ ID NO: 739077 - DNA, 13 bp, C. elegans
tttaacttcttaa

SEQ ID NO: 739078 - DNA, 13 bp, C. elegans
tttaacttgattt

SEQ ID NO: 739079 - DNA, 13 bp, C. elegans
tttaactttacaa

SEQ ID NO: 739080 - DNA, 13 bp, C. elegans
tttaactttccaa

SEQ ID NO: 739081 - DNA, 13 bp, C. elegans
tttaactttgaaa

SEQ ID NO: 739082 - DNA, 13 bp, C. elegans
tttaactttgata

SEQ ID NO: 739083 - DNA, 13 bp, C. elegans
tttaacttttcaa

SEQ ID NO: 739084 - DNA, 13 bp, C. elegans
tttaacttttcca

SEQ ID NO: 739085 - DNA, 13 bp, C. elegans
tttaactttttga

SEQ ID NO: 739086 - DNA, 13 bp, C. elegans
tttaagaaaaagt

SEQ ID NO: 739087 - DNA, 13 bp, C. elegans
tttaagaacattt

SEQ ID NO: 739088 - DNA, 13 bp, C. elegans
tttaagaattact

SEQ ID NO: 739089 - DNA, 13 bp, C. elegans
tttaagaatttca

SEQ ID NO: 739090 - DNA, 13 bp, C. elegans
tttaagacatgca

SEQ ID NO: 739091 - DNA, 13 bp, C. elegans
tttaagacatttt

SEQ ID NO: 739092 - DNA, 13 bp, C. elegans
tttaagacggaaa

SEQ ID NO: 739093 - DNA, 13 bp, C. elegans
tttaagacttttc

SEQ ID NO: 739094 - DNA, 13 bp, C. elegans
tttaagcctaaaa

SEQ ID NO: 739095 - DNA, 13 bp, C. elegans
tttaagcgggaaa

SEQ ID NO: 739096 - DNA, 13 bp, C. elegans
tttaagctatttt

SEQ ID NO: 739097 - DNA, 13 bp, C. elegans
tttaagctgattt

SEQ ID NO: 739098 - DNA, 13 bp, C. elegans
tttaagcttgaaa

SEQ ID NO: 739099 - DNA, 13 bp, C. elegans
tttaagctttcaa

SEQ ID NO: 739100 - DNA, 13 bp, C. elegans
tttaagcttttct

SEQ ID NO: 739101 - DNA, 13 bp, C. elegans
tttaaggttttaa

SEQ ID NO: 739102 - DNA, 13 bp, C. elegans
tttaagtgcattt

SEQ ID NO: 739103 - DNA, 13 bp, C. elegans
tttaagtggattt

SEQ ID NO: 739104 - DNA, 13 bp, C. elegans
tttaagtgtaaac

SEQ ID NO: 739105 - DNA, 13 bp, C. elegans
tttaagtgtttct

SEQ ID NO: 739106 - DNA, 13 bp, C. elegans
tttaagttattca

SEQ ID NO: 739107 - DNA, 13 bp, C. elegans
tttaagttatttc

SEQ ID NO: 739108 - DNA, 13 bp, C. elegans
tttaagtttcatt

SEQ ID NO: 739109 - DNA, 13 bp, C. elegans
tttaagttttact

SEQ ID NO: 739110 - DNA, 13 bp, C. elegans
tttaagttttaga

SEQ ID NO: 739111 - DNA, 13 bp, C. elegans
tttaataaagcaa

SEQ ID NO: 739112 - DNA, 13 bp, C. elegans
tttaataacttgg

SEQ ID NO: 739113 - DNA, 13 bp, C. elegans
tttaatacatttg

SEQ ID NO: 739114 - DNA, 13 bp, C. elegans
tttaatagaacaa

SEQ ID NO: 739115 - DNA, 13 bp, C. elegans
tttaatagagttt

SEQ ID NO: 739116 - DNA, 13 bp, C. elegans
tttaataggaaaa

SEQ ID NO: 739117 - DNA, 13 bp, C. elegans
tttaatatgttct

SEQ ID NO: 739118 - DNA, 13 bp, C. elegans
tttaatatttcca

SEQ ID NO: 739119 - DNA, 13 bp, C. elegans
tttaatcaaagtt

SEQ ID NO: 739120 - DNA, 13 bp, C. elegans
tttaatcagaaat

SEQ ID NO: 739121 - DNA, 13 bp, C. elegans
tttaatcagattt

SEQ ID NO: 739122 - DNA, 13 bp, C. elegans
tttaatcagtttt

SEQ ID NO: 739123 - DNA, 13 bp, C. elegans
tttaatccaaaaa

SEQ ID NO: 739124 - DNA, 13 bp, C. elegans
tttaatccaaatt

SEQ ID NO: 739125 - DNA, 13 bp, C. elegans
tttaatcctattc

SEQ ID NO: 739126 - DNA, 13 bp, C. elegans
tttaatcgaaata

SEQ ID NO: 739127 - DNA, 13 bp, C. elegans
tttaatcgatttt

SEQ ID NO: 739128 - DNA, 13 bp, C. elegans
tttaatcgctttt

SEQ ID NO: 739129 - DNA, 13 bp, C. elegans
tttaatcgttttc

SEQ ID NO: 739130 - DNA, 13 bp, C. elegans
tttaatctcaaaa

SEQ ID NO: 739131 - DNA, 13 bp, C. elegans
tttaatgaaaaag

SEQ ID NO: 739132 - DNA, 13 bp, C. elegans
tttaatgaaaagt

SEQ ID NO: 739133 - DNA, 13 bp, C. elegans
tttaatgaaatct

SEQ ID NO: 739134 - DNA, 13 bp, C. elegans
tttaatgaacaaa

SEQ ID NO: 739135 - DNA, 13 bp, C. elegans
tttaatgaagttt

SEQ ID NO: 739136 - DNA, 13 bp, C. elegans
tttaatgaatgaa

SEQ ID NO: 739137 - DNA, 13 bp, C. elegans
tttaatgagaaat

SEQ ID NO: 739138 - DNA, 13 bp, C. elegans
tttaatgagtact

SEQ ID NO: 739139 - DNA, 13 bp, C. elegans
tttaatgcaaaaa

SEQ ID NO: 739140 - DNA, 13 bp, C. elegans
tttaatgcaaaac

SEQ ID NO: 739141 - DNA, 13 bp, C. elegans
tttaatgcaattt

SEQ ID NO: 739142 - DNA, 13 bp, C. elegans
tttaatgcatgtt

SEQ ID NO: 739143 - DNA, 13 bp, C. elegans
tttaatgctaatt

SEQ ID NO: 739144 - DNA, 13 bp, C. elegans
tttaatgctgaaa

SEQ ID NO: 739145 - DNA, 13 bp, C. elegans
tttaatggaaatt

SEQ ID NO: 739146 - DNA, 13 bp, C. elegans
tttaatgtagaaa

SEQ ID NO: 739147 - DNA, 13 bp, C. elegans
tttaatgtattac

SEQ ID NO: 739148 - DNA, 13 bp, C. elegans
tttaatgtcaaaa

SEQ ID NO: 739149 - DNA, 13 bp, C. elegans
tttaatgtgaatt

SEQ ID NO: 739150 - DNA, 13 bp, C. elegans
tttaatgttcatt

SEQ ID NO: 739151 - DNA, 13 bp, C. elegans
tttaatgttttcc

SEQ ID NO: 739152 - DNA, 13 bp, C. elegans
tttaattatccaa

SEQ ID NO: 739153 - DNA, 13 bp, C. elegans
tttaattatcgtt

SEQ ID NO: 739154 - DNA, 13 bp, C. elegans
tttaattattcca

SEQ ID NO: 739155 - DNA, 13 bp, C. elegans
tttaattcacaaa

SEQ ID NO: 739156 - DNA, 13 bp, C. elegans
tttaattcagttt

SEQ ID NO: 739157 - DNA, 13 bp, C. elegans
tttaattcgaaaa

SEQ ID NO: 739158 - DNA, 13 bp, C. elegans
tttaattcgaaat

SEQ ID NO: 739159 - DNA, 13 bp, C. elegans
tttaattcgattt

SEQ ID NO: 739160 - DNA, 13 bp, C. elegans
tttaattcggaaa

SEQ ID NO: 739161 - DNA, 13 bp, C. elegans
tttaattctagtt

SEQ ID NO: 739162 - DNA, 13 bp, C. elegans
tttaattctctca

SEQ ID NO: 739163 - DNA, 13 bp, C. elegans
tttaattctgaaa

SEQ ID NO: 739164 - DNA, 13 bp, C. elegans
tttaattctgatt

SEQ ID NO: 739165 - DNA, 13 bp, C. elegans
tttaattctgcaa

SEQ ID NO: 739166 - DNA, 13 bp, C. elegans
tttaattcttgaa

SEQ ID NO: 739167 - DNA, 13 bp, C. elegans
tttaattgaacaa

SEQ ID NO: 739168 - DNA, 13 bp, C. elegans
tttaattgaacat

SEQ ID NO: 739169 - DNA, 13 bp, C. elegans
tttaattgactcc

SEQ ID NO: 739170 - DNA, 13 bp, C. elegans
tttaattgacttt

SEQ ID NO: 739171 - DNA, 13 bp, C. elegans
tttaattgataga

SEQ ID NO: 739172 - DNA, 13 bp, C. elegans
tttaattgctaga

SEQ ID NO: 739173 - DNA, 13 bp, C. elegans
tttaattggaatt

SEQ ID NO: 739174 - DNA, 13 bp, C. elegans
tttaattggagaa

SEQ ID NO: 739175 - DNA, 13 bp, C. elegans
tttaattgtattc

SEQ ID NO: 739176 - DNA, 13 bp, C. elegans
tttaattgtgaaa

SEQ ID NO: 739177 - DNA, 13 bp, C. elegans
tttaattgttgaa

SEQ ID NO: 739178 - DNA, 13 bp, C. elegans
tttaattgttgca

SEQ ID NO: 739179 - DNA, 13 bp, C. elegans
tttaattgtttca

SEQ ID NO: 739180 - DNA, 13 bp, C. elegans
tttaatttcaaac

SEQ ID NO: 739181 - DNA, 13 bp, C. elegans
tttaatttcaagt

SEQ ID NO: 739182 - DNA, 13 bp, C. elegans
tttaatttcacat

SEQ ID NO: 739183 - DNA, 13 bp, C. elegans
tttaatttcacct

SEQ ID NO: 739184 - DNA, 13 bp, C. elegans
tttaatttcagat

SEQ ID NO: 739185 - DNA, 13 bp, C. elegans
tttaatttcagtt

SEQ ID NO: 739186 - DNA, 13 bp, C. elegans
tttaatttccaaa

SEQ ID NO: 739187 - DNA, 13 bp, C. elegans
tttaatttcctaa

SEQ ID NO: 739188 - DNA, 13 bp, C. elegans
tttaatttcgcga

SEQ ID NO: 739189 - DNA, 13 bp, C. elegans
tttaatttctaac

SEQ ID NO: 739190 - DNA, 13 bp, C. elegans
tttaatttctaga

SEQ ID NO: 739191 - DNA, 13 bp, C. elegans
tttaatttctagg

SEQ ID NO: 739192 - DNA, 13 bp, C. elegans
tttaatttgaaag

SEQ ID NO: 739193 - DNA, 13 bp, C. elegans
tttaatttgaaga

SEQ ID NO: 739194 - DNA, 13 bp, C. elegans
tttaatttgatca

SEQ ID NO: 739195 - DNA, 13 bp, C. elegans
tttaattttacag

SEQ ID NO: 739196 - DNA, 13 bp, C. elegans
tttaattttcaca

SEQ ID NO: 739197 - DNA, 13 bp, C. elegans
tttaattttcagg

SEQ ID NO: 739198 - DNA, 13 bp, C. elegans
tttaattttcagt

SEQ ID NO: 739199 - DNA, 13 bp, C. elegans
tttaattttcatg

SEQ ID NO: 739200 - DNA, 13 bp, C. elegans
tttaattttcccc

SEQ ID NO: 739201 - DNA, 13 bp, C. elegans
tttaattttctag

SEQ ID NO: 739202 - DNA, 13 bp, C. elegans
tttaattttgaga

SEQ ID NO: 739203 - DNA, 13 bp, C. elegans
tttaattttgcaa

SEQ ID NO: 739204 - DNA, 13 bp, C. elegans
tttaattttgcca

SEQ ID NO: 739205 - DNA, 13 bp, C. elegans
tttaatttttacg

SEQ ID NO: 739206 - DNA, 13 bp, C. elegans
tttaatttttccg

SEQ ID NO: 739207 - DNA, 13 bp, C. elegans
tttaatttttcga

SEQ ID NO: 739208 - DNA, 13 bp, C. elegans
tttacaaaaaatc

SEQ ID NO: 739209 - DNA, 13 bp, C. elegans
tttacaaaaagtt

SEQ ID NO: 739210 - DNA, 13 bp, C. elegans
tttacaaaaatcg

SEQ ID NO: 739211 - DNA, 13 bp, C. elegans
tttacaaaaatgt

SEQ ID NO: 739212 - DNA, 13 bp, C. elegans
tttacaaaactac

SEQ ID NO: 739213 - DNA, 13 bp, C. elegans
tttacaaaacttt

SEQ ID NO: 739214 - DNA, 13 bp, C. elegans
tttacaaaatatc

SEQ ID NO: 739215 - DNA, 13 bp, C. elegans
tttacaaaatcta

SEQ ID NO: 739216 - DNA, 13 bp, C. elegans
tttacaaagaaaa

SEQ ID NO: 739217 - DNA, 13 bp, C. elegans
tttacaaagattt

SEQ ID NO: 739218 - DNA, 13 bp, C. elegans
tttacaaatacaa

SEQ ID NO: 739219 - DNA, 13 bp, C. elegans
tttacaaatattc

SEQ ID NO: 739220 - DNA, 13 bp, C. elegans
tttacaaatgttc

SEQ ID NO: 739221 - DNA, 13 bp, C. elegans
tttacaaattcaa

SEQ ID NO: 739222 - DNA, 13 bp, C. elegans
tttacaaattttc

SEQ ID NO: 739223 - DNA, 13 bp, C. elegans
tttacaacaaatt

SEQ ID NO: 739224 - DNA, 13 bp, C. elegans
tttacaacaatat

SEQ ID NO: 739225 - DNA, 13 bp, C. elegans
tttacaacatttt

SEQ ID NO: 739226 - DNA, 13 bp, C. elegans
tttacaactaaaa

SEQ ID NO: 739227 - DNA, 13 bp, C. elegans
tttacaactaatt

SEQ ID NO: 739228 - DNA, 13 bp, C. elegans
tttacaagaaaac

SEQ ID NO: 739229 - DNA, 13 bp, C. elegans
tttacaagaaaat

SEQ ID NO: 739230 - DNA, 13 bp, C. elegans
tttacaagtattt

SEQ ID NO: 739231 - DNA, 13 bp, C. elegans
tttacaataaaac

SEQ ID NO: 739232 - DNA, 13 bp, C. elegans
tttacaataaaag

SEQ ID NO: 739233 - DNA, 13 bp, C. elegans
tttacaataactt

SEQ ID NO: 739234 - DNA, 13 bp, C. elegans
tttacaataagaa

SEQ ID NO: 739235 - DNA, 13 bp, C. elegans
tttacaatacaat

SEQ ID NO: 739236 - DNA, 13 bp, C. elegans
tttacaatatttg

SEQ ID NO: 739237 - DNA, 13 bp, C. elegans
tttacaattcata

SEQ ID NO: 739238 - DNA, 13 bp, C. elegans
tttacaatttaac

SEQ ID NO: 739239 - DNA, 13 bp, C. elegans
tttacaatttatg

SEQ ID NO: 739240 - DNA, 13 bp, C. elegans
tttacaatttcag

SEQ ID NO: 739241 - DNA, 13 bp, C. elegans
tttacaatttcca

SEQ ID NO: 739242 - DNA, 13 bp, C. elegans
tttacaatttccc

SEQ ID NO: 739243 - DNA, 13 bp, C. elegans
tttacaattttag

SEQ ID NO: 739244 - DNA, 13 bp, C. elegans
tttacaattttca

SEQ ID NO: 739245 - DNA, 13 bp, C. elegans
tttacaattttcc

SEQ ID NO: 739246 - DNA, 13 bp, C. elegans
tttacacaaaaat

SEQ ID NO: 739247 - DNA, 13 bp, C. elegans
tttacacaaaact

SEQ ID NO: 739248 - DNA, 13 bp, C. elegans
tttacacaaattt

SEQ ID NO: 739249 - DNA, 13 bp, C. elegans
tttacacagaaac

SEQ ID NO: 739250 - DNA, 13 bp, C. elegans
tttacacataaat

SEQ ID NO: 739251 - DNA, 13 bp, C. elegans
tttacacatattt

SEQ ID NO: 739252 - DNA, 13 bp, C. elegans
tttacacatttca

SEQ ID NO: 739253 - DNA, 13 bp, C. elegans
tttacacgatttt

SEQ ID NO: 739254 - DNA, 13 bp, C. elegans
tttacacggaagc

SEQ ID NO: 739255 - DNA, 13 bp, C. elegans
tttacacgtgttt

SEQ ID NO: 739256 - DNA, 13 bp, C. elegans
tttacactacttt

SEQ ID NO: 739257 - DNA, 13 bp, C. elegans
tttacactatttc

SEQ ID NO: 739258 - DNA, 13 bp, C. elegans
tttacactgaaaa

SEQ ID NO: 739259 - DNA, 13 bp, C. elegans
tttacactgtttt

SEQ ID NO: 739260 - DNA, 13 bp, C. elegans
tttacacttaaaa

SEQ ID NO: 739261 - DNA, 13 bp, C. elegans
tttacactttttg

SEQ ID NO: 739262 - DNA, 13 bp, C. elegans
tttacagaaaatt

SEQ ID NO: 739263 - DNA, 13 bp, C. elegans
tttacagaaatca

SEQ ID NO: 739264 - DNA, 13 bp, C. elegans
tttacagaaggaa

SEQ ID NO: 739265 - DNA, 13 bp, C. elegans
tttacagaatatt

SEQ ID NO: 739266 - DNA, 13 bp, C. elegans
tttacagaatttg

SEQ ID NO: 739267 - DNA, 13 bp, C. elegans
tttacagagaaat

SEQ ID NO: 739268 - DNA, 13 bp, C. elegans
tttacagagattt

SEQ ID NO: 739269 - DNA, 13 bp, C. elegans
tttacagattttt

SEQ ID NO: 739270 - DNA, 13 bp, C. elegans
tttacagcaaaat

SEQ ID NO: 739271 - DNA, 13 bp, C. elegans
tttacagcatttt

SEQ ID NO: 739272 - DNA, 13 bp, C. elegans
tttacagtatttt

SEQ ID NO: 739273 - DNA, 13 bp, C. elegans
tttacagtcgaaa

SEQ ID NO: 739274 - DNA, 13 bp, C. elegans
tttacagtgaaaa

SEQ ID NO: 739275 - DNA, 13 bp, C. elegans
tttacagttataa

SEQ ID NO: 739276 - DNA, 13 bp, C. elegans
tttacagttattt

SEQ ID NO: 739277 - DNA, 13 bp, C. elegans
tttacagtttcaa

SEQ ID NO: 739278 - DNA, 13 bp, C. elegans
tttacagttttat

SEQ ID NO: 739279 - DNA, 13 bp, C. elegans
tttacagtttttc

SEQ ID NO: 739280 - DNA, 13 bp, C. elegans
tttacatattctg

SEQ ID NO: 739281 - DNA, 13 bp, C. elegans
tttacatgatttt

SEQ ID NO: 739282 - DNA, 13 bp, C. elegans
tttacatgtaaaa

SEQ ID NO: 739283 - DNA, 13 bp, C. elegans
tttacattttcac

SEQ ID NO: 739284 - DNA, 13 bp, C. elegans
tttacatttttgc

SEQ ID NO: 739285 - DNA, 13 bp, C. elegans
tttaccaaaaact

SEQ ID NO: 739286 - DNA, 13 bp, C. elegans
tttaccaaaaagt

SEQ ID NO: 739287 - DNA, 13 bp, C. elegans
tttaccaaaaata

SEQ ID NO: 739288 - DNA, 13 bp, C. elegans
tttaccaaaaatc

SEQ ID NO: 739289 - DNA, 13 bp, C. elegans
tttaccaaaaatt

SEQ ID NO: 739290 - DNA, 13 bp, C. elegans
tttaccaaaactt

SEQ ID NO: 739291 - DNA, 13 bp, C. elegans
tttaccaaaatgt

SEQ ID NO: 739292 - DNA, 13 bp, C. elegans
tttaccaaatcaa

SEQ ID NO: 739293 - DNA, 13 bp, C. elegans
tttaccaaatctc

SEQ ID NO: 739294 - DNA, 13 bp, C. elegans
tttaccaaatttt

SEQ ID NO: 739295 - DNA, 13 bp, C. elegans
tttaccaacaaca

SEQ ID NO: 739296 - DNA, 14 bp, C. elegans
tttaccaattttca

SEQ ID NO: 739297 - DNA, 13 bp, C. elegans
tttaccacatttt

SEQ ID NO: 739298 - DNA, 13 bp, C. elegans
tttaccacttttc

SEQ ID NO: 739299 - DNA, 13 bp, C. elegans
tttaccagttttc

SEQ ID NO: 739300 - DNA, 13 bp, C. elegans
tttaccatttttg

SEQ ID NO: 739301 - DNA, 13 bp, C. elegans
tttacccaaaaaa

SEQ ID NO: 739302 - DNA, 13 bp, C. elegans
tttacccaatttt

SEQ ID NO: 739303 - DNA, 13 bp, C. elegans
tttacccagtttt

SEQ ID NO: 739304 - DNA, 13 bp, C. elegans
tttacccgaaaaa

SEQ ID NO: 739305 - DNA, 13 bp, C. elegans
tttaccctgaaaa

SEQ ID NO: 739306 - DNA, 13 bp, C. elegans
tttaccgaaaatt

SEQ ID NO: 739307 - DNA, 13 bp, C. elegans
tttaccgaaactt

SEQ ID NO: 739308 - DNA, 13 bp, C. elegans
tttaccgccaaaa

SEQ ID NO: 739309 - DNA, 13 bp, C. elegans
tttaccggttttt

SEQ ID NO: 739310 - DNA, 13 bp, C. elegans
tttaccgtatttt

SEQ ID NO: 739311 - DNA, 13 bp, C. elegans
tttaccgttttat

SEQ ID NO: 739312 - DNA, 13 bp, C. elegans
tttacctagtttt

SEQ ID NO: 739313 - DNA, 13 bp, C. elegans
tttacctgaattt

SEQ ID NO: 739314 - DNA, 13 bp, C. elegans
tttaccttcaaaa

SEQ ID NO: 739315 - DNA, 13 bp, C. elegans
tttacgaaaaact

SEQ ID NO: 739316 - DNA, 13 bp, C. elegans
tttacgaaaataa

SEQ ID NO: 739317 - DNA, 13 bp, C. elegans
tttacgaattttt

SEQ ID NO: 739318 - DNA, 13 bp, C. elegans
tttacgacaaaat

SEQ ID NO: 739319 - DNA, 13 bp, C. elegans
tttacgagaaaat

SEQ ID NO: 739320 - DNA, 13 bp, C. elegans
tttacgatatgat

SEQ ID NO: 739321 - DNA, 13 bp, C. elegans
tttacgatttttg

SEQ ID NO: 739322 - DNA, 13 bp, C. elegans
tttacgcaatttt

SEQ ID NO: 739323 - DNA, 13 bp, C. elegans
tttacgccaaaat

SEQ ID NO: 739324 - DNA, 13 bp, C. elegans
tttacgccaattt

SEQ ID NO: 739325 - DNA, 13 bp, C. elegans
tttacgcgcaaat

SEQ ID NO: 739326 - DNA, 13 bp, C. elegans
tttacggaaaata

SEQ ID NO: 739327 - DNA, 13 bp, C. elegans
tttacggaatttt

SEQ ID NO: 739328 - DNA, 13 bp, C. elegans
tttacggagtttt

SEQ ID NO: 739329 - DNA, 13 bp, C. elegans
tttacgtaaaaaa

SEQ ID NO: 739330 - DNA, 13 bp, C. elegans
tttacgtattttc

SEQ ID NO: 739331 - DNA, 13 bp, C. elegans
tttacgttgaaaa

SEQ ID NO: 739332 - DNA, 13 bp, C. elegans
tttacgtttaaaa

SEQ ID NO: 739333 - DNA, 13 bp, C. elegans
tttactaaaatca

SEQ ID NO: 739334 - DNA, 13 bp, C. elegans
tttactaaaatct

SEQ ID NO: 739335 - DNA, 13 bp, C. elegans
tttactaaacaaa

SEQ ID NO: 739336 - DNA, 13 bp, C. elegans
tttactacaaaat

SEQ ID NO: 739337 - DNA, 13 bp, C. elegans
tttactacaaatt

SEQ ID NO: 739338 - DNA, 13 bp, C. elegans
tttactacagtac

SEQ ID NO: 739339 - DNA, 13 bp, C. elegans
tttactacgaatt

SEQ ID NO: 739340 - DNA, 13 bp, C. elegans
tttactagatttt

SEQ ID NO: 739341 - DNA, 13 bp, C. elegans
tttactatcaaaa

SEQ ID NO: 739342 - DNA, 13 bp, C. elegans
tttactattgaaa

SEQ ID NO: 739343 - DNA, 13 bp, C. elegans
tttactatttcag

SEQ ID NO: 739344 - DNA, 13 bp, C. elegans
tttactattttga

SEQ ID NO: 739345 - DNA, 13 bp, C. elegans
tttactcaaatta

SEQ ID NO: 739346 - DNA, 13 bp, C. elegans
tttactcatttac

SEQ ID NO: 739347 - DNA, 13 bp, C. elegans
tttactcgaaatt

SEQ ID NO: 739348 - DNA, 13 bp, C. elegans
tttactgacaaaa

SEQ ID NO: 739349 - DNA, 13 bp, C. elegans
tttactgactttt

SEQ ID NO: 739350 - DNA, 13 bp, C. elegans
tttactgataaaa

SEQ ID NO: 739351 - DNA, 13 bp, C. elegans
tttactgatattt

SEQ ID NO: 739352 - DNA, 13 bp, C. elegans
tttactggaaaaa

SEQ ID NO: 739353 - DNA, 13 bp, C. elegans
tttactggaaatt

SEQ ID NO: 739354 - DNA, 13 bp, C. elegans
tttactggaattt

SEQ ID NO: 739355 - DNA, 13 bp, C. elegans
tttactgtaaaac

SEQ ID NO: 739356 - DNA, 13 bp, C. elegans
tttactgtgattt

SEQ ID NO: 739357 - DNA, 13 bp, C. elegans
tttacttcaaaaa

SEQ ID NO: 739358 - DNA, 13 bp, C. elegans
tttacttcaaatt

SEQ ID NO: 739359 - DNA, 13 bp, C. elegans
tttacttcagaaa

SEQ ID NO: 739360 - DNA, 13 bp, C. elegans
tttacttctaaaa

SEQ ID NO: 739361 - DNA, 13 bp, C. elegans
tttacttggcatt

SEQ ID NO: 739362 - DNA, 13 bp, C. elegans
tttactttaacaa

SEQ ID NO: 739363 - DNA, 13 bp, C. elegans
tttactttcaaaa

SEQ ID NO: 739364 - DNA, 13 bp, C. elegans
tttacttttcaaa

SEQ ID NO: 739365 - DNA, 13 bp, C. elegans
tttacttttccag

SEQ ID NO: 739366 - DNA, 13 bp, C. elegans
tttagaaaaaagt

SEQ ID NO: 739367 - DNA, 13 bp, C. elegans
tttagaaaaaatc

SEQ ID NO: 739368 - DNA, 13 bp, C. elegans
tttagaaaaactt

SEQ ID NO: 739369 - DNA, 13 bp, C. elegans
tttagaaaactcg

SEQ ID NO: 739370 - DNA, 13 bp, C. elegans
tttagaaaactgt

SEQ ID NO: 739371 - DNA, 13 bp, C. elegans
tttagaaaagagt

SEQ ID NO: 739372 - DNA, 13 bp, C. elegans
tttagaaaataac

SEQ ID NO: 739373 - DNA, 13 bp, C. elegans
tttagaaaattga

SEQ ID NO: 739374 - DNA, 13 bp, C. elegans
tttagaaacaaat

SEQ ID NO: 739375 - DNA, 13 bp, C. elegans
tttagaaagaatt

SEQ ID NO: 739376 - DNA, 13 bp, C. elegans
tttagaaatgaaa

SEQ ID NO: 739377 - DNA, 13 bp, C. elegans
tttagaaattgga

SEQ ID NO: 739378 - DNA, 13 bp, C. elegans
tttagaaattgtt

SEQ ID NO: 739379 - DNA, 13 bp, C. elegans
tttagaacaaaaa

SEQ ID NO: 739380 - DNA, 13 bp, C. elegans
tttagaacatttg

SEQ ID NO: 739381 - DNA, 13 bp, C. elegans
tttagaacatttt

SEQ ID NO: 739382 - DNA, 13 bp, C. elegans
tttagaacgattt

SEQ ID NO: 739383 - DNA, 13 bp, C. elegans
tttagaacgggaa

SEQ ID NO: 739384 - DNA, 13 bp, C. elegans
tttagaactttaa

SEQ ID NO: 739385 - DNA, 13 bp, C. elegans
tttagaagaaatg

SEQ ID NO: 739386 - DNA, 13 bp, C. elegans
tttagaagaagaa

SEQ ID NO: 739387 - DNA, 13 bp, C. elegans
tttagaatcaaaa

SEQ ID NO: 739388 - DNA, 13 bp, C. elegans
tttagaatgaaaa

SEQ ID NO: 739389 - DNA, 13 bp, C. elegans
tttagaatgattt

SEQ ID NO: 739390 - DNA, 13 bp, C. elegans
tttagaattacaa

SEQ ID NO: 739391 - DNA, 13 bp, C. elegans
tttagaattcttt

SEQ ID NO: 739392 - DNA, 13 bp, C. elegans
tttagaattgaat

SEQ ID NO: 739393 - DNA, 13 bp, C. elegans
tttagaatttaca

SEQ ID NO: 739394 - DNA, 13 bp, C. elegans
tttagaattttca

SEQ ID NO: 739395 - DNA, 13 bp, C. elegans
tttagaatttttc

SEQ ID NO: 739396 - DNA, 13 bp, C. elegans
tttagacaatttc

SEQ ID NO: 739397 - DNA, 13 bp, C. elegans
tttagacacattt

SEQ ID NO: 739398 - DNA, 13 bp, C. elegans
tttagacattttc

SEQ ID NO: 739399 - DNA, 13 bp, C. elegans
tttagacgatttt

SEQ ID NO: 739400 - DNA, 13 bp, C. elegans
tttagactaaaaa

SEQ ID NO: 739401 - DNA, 13 bp, C. elegans
tttagactacaaa

SEQ ID NO: 739402 - DNA, 13 bp, C. elegans
tttagacttaaaa

SEQ ID NO: 739403 - DNA, 13 bp, C. elegans
tttagacttttaa

SEQ ID NO: 739404 - DNA, 13 bp, C. elegans
tttagagaaaaag

SEQ ID NO: 739405 - DNA, 13 bp, C. elegans
tttagagaaagtt

SEQ ID NO: 739406 - DNA, 13 bp, C. elegans
tttagagaaattc

SEQ ID NO: 739407 - DNA, 13 bp, C. elegans
tttagagaataaa

SEQ ID NO: 739408 - DNA, 13 bp, C. elegans
tttagagaattta

SEQ ID NO: 739409 - DNA, 13 bp, C. elegans
tttagagacaaaa

SEQ ID NO: 739410 - DNA, 13 bp, C. elegans
tttagaggaaaaa

SEQ ID NO: 739411 - DNA, 13 bp, C. elegans
tttagataatttc

SEQ ID NO: 739412 - DNA, 13 bp, C. elegans
tttagatcaaaaa

SEQ ID NO: 739413 - DNA, 13 bp, C. elegans
tttagatcatttt

SEQ ID NO: 739414 - DNA, 13 bp, C. elegans
tttagatgaaaaa

SEQ ID NO: 739415 - DNA, 13 bp, C. elegans
tttagattcaaaa

SEQ ID NO: 739416 - DNA, 13 bp, C. elegans
tttagattcattt

SEQ ID NO: 739417 - DNA, 13 bp, C. elegans
tttagattttcag

SEQ ID NO: 739418 - DNA, 13 bp, C. elegans
tttagattttctg

SEQ ID NO: 739419 - DNA, 13 bp, C. elegans
tttagcaaaatat

SEQ ID NO: 739420 - DNA, 13 bp, C. elegans
tttagcaacattt

SEQ ID NO: 739421 - DNA, 13 bp, C. elegans
tttagcaagaaaa

SEQ ID NO: 739422 - DNA, 13 bp, C. elegans
tttagcaatttcc

SEQ ID NO: 739423 - DNA, 13 bp, C. elegans
tttagcaattttt

SEQ ID NO: 739424 - DNA, 13 bp, C. elegans
tttagcagattcc

SEQ ID NO: 739425 - DNA, 13 bp, C. elegans
tttagcaggaaaa

SEQ ID NO: 739426 - DNA, 13 bp, C. elegans
tttagcagtttat

SEQ ID NO: 739427 - DNA, 13 bp, C. elegans
tttagcataaaat

SEQ ID NO: 739428 - DNA, 13 bp, C. elegans
tttagcataaggt

SEQ ID NO: 739429 - DNA, 13 bp, C. elegans
tttagcattaaaa

SEQ ID NO: 739430 - DNA, 13 bp, C. elegans
tttagccaatttt

SEQ ID NO: 739431 - DNA, 13 bp, C. elegans
tttagccattttc

SEQ ID NO: 739432 - DNA, 13 bp, C. elegans
tttagcccaaaaa

SEQ ID NO: 739433 - DNA, 13 bp, C. elegans
tttagccgaaatt

SEQ ID NO: 739434 - DNA, 13 bp, C. elegans
tttagcctaaaaa

SEQ ID NO: 739435 - DNA, 13 bp, C. elegans
tttagccttaaaa

SEQ ID NO: 739436 - DNA, 13 bp, C. elegans
tttagcgattttt

SEQ ID NO: 739437 - DNA, 13 bp, C. elegans
tttagcggcggaa

SEQ ID NO: 739438 - DNA, 13 bp, C. elegans
tttagcgtgtttt

SEQ ID NO: 739439 - DNA, 13 bp, C. elegans
tttagctaaaaaa

SEQ ID NO: 739440 - DNA, 13 bp, C. elegans
tttagctaaaaat

SEQ ID NO: 739441 - DNA, 13 bp, C. elegans
tttagctaaaatc

SEQ ID NO: 739442 - DNA, 13 bp, C. elegans
tttagctcaaaat

SEQ ID NO: 739443 - DNA, 13 bp, C. elegans
tttagctcatttt

SEQ ID NO: 739444 - DNA, 13 bp, C. elegans
tttagctgaaaaa

SEQ ID NO: 739445 - DNA, 13 bp, C. elegans
tttaggctatttt

SEQ ID NO: 739446 - DNA, 13 bp, C. elegans
tttaggctttttc

SEQ ID NO: 739447 - DNA, 13 bp, C. elegans
tttaggtcatttt

SEQ ID NO: 739448 - DNA, 13 bp, C. elegans
tttaggttcaaat

SEQ ID NO: 739449 - DNA, 13 bp, C. elegans
tttaggttttcaa

SEQ ID NO: 739450 - DNA, 13 bp, C. elegans
tttagtaaaatga

SEQ ID NO: 739451 - DNA, 13 bp, C. elegans
tttagtacaattt

SEQ ID NO: 739452 - DNA, 13 bp, C. elegans
tttagtatttgaa

SEQ ID NO: 739453 - DNA, 13 bp, C. elegans
tttagtcaatttt

SEQ ID NO: 739454 - DNA, 13 bp, C. elegans
tttagtcatattt

SEQ ID NO: 739455 - DNA, 13 bp, C. elegans
tttagtcgaaaaa

SEQ ID NO: 739456 - DNA, 13 bp, C. elegans
tttagtgaaaaag

SEQ ID NO: 739457 - DNA, 13 bp, C. elegans
tttagtgaaaatt

SEQ ID NO: 739458 - DNA, 13 bp, C. elegans
tttagtgaaattc

SEQ ID NO: 739459 - DNA, 13 bp, C. elegans
tttagtgataaaa

SEQ ID NO: 739460 - DNA, 13 bp, C. elegans
tttagtgcaaaaa

SEQ ID NO: 739461 - DNA, 13 bp, C. elegans
tttagtggaaaaa

SEQ ID NO: 739462 - DNA, 13 bp, C. elegans
tttagtggaaatt

SEQ ID NO: 739463 - DNA, 13 bp, C. elegans
tttagtgttaaaa

SEQ ID NO: 739464 - DNA, 13 bp, C. elegans
tttagttattgaa

SEQ ID NO: 739465 - DNA, 13 bp, C. elegans
tttagttcaaaat

SEQ ID NO: 739466 - DNA, 13 bp, C. elegans
tttagttcaaata

SEQ ID NO: 739467 - DNA, 13 bp, C. elegans
tttagttcaattt

SEQ ID NO: 739468 - DNA, 13 bp, C. elegans
tttagttcatttc

SEQ ID NO: 739469 - DNA, 13 bp, C. elegans
tttagttctgaaa

SEQ ID NO: 739470 - DNA, 13 bp, C. elegans
tttagttgaaaat

SEQ ID NO: 739471 - DNA, 13 bp, C. elegans
tttagttgaaatt

SEQ ID NO: 739472 - DNA, 13 bp, C. elegans
tttagttgaactt

SEQ ID NO: 739473 - DNA, 13 bp, C. elegans
tttagttgagaaa

SEQ ID NO: 739474 - DNA, 13 bp, C. elegans
tttagttgatcac

SEQ ID NO: 739475 - DNA, 13 bp, C. elegans
tttagttgtaaaa

SEQ ID NO: 739476 - DNA, 13 bp, C. elegans
tttagtttcgaaa

SEQ ID NO: 739477 - DNA, 13 bp, C. elegans
tttagttttctga

SEQ ID NO: 739478 - DNA, 13 bp, C. elegans
tttagttttggaa

SEQ ID NO: 739479 - DNA, 13 bp, C. elegans
tttataaaaacca

SEQ ID NO: 739480 - DNA, 13 bp, C. elegans
tttataaaaatgg

SEQ ID NO: 739481 - DNA, 13 bp, C. elegans
tttataaacgaaa

SEQ ID NO: 739482 - DNA, 13 bp, C. elegans
tttataaactgaa

SEQ ID NO: 739483 - DNA, 13 bp, C. elegans
tttataaactttc

SEQ ID NO: 739484 - DNA, 13 bp, C. elegans
tttataaagaagt

SEQ ID NO: 739485 - DNA, 13 bp, C. elegans
tttataaattcag

SEQ ID NO: 739486 - DNA, 13 bp, C. elegans
tttataacagaaa

SEQ ID NO: 739487 - DNA, 13 bp, C. elegans
tttataacgaaaa

SEQ ID NO: 739488 - DNA, 13 bp, C. elegans
tttataactcaac

SEQ ID NO: 739489 - DNA, 13 bp, C. elegans
tttataaggagtt

SEQ ID NO: 739490 - DNA, 13 bp, C. elegans
tttataatccaaa

SEQ ID NO: 739491 - DNA, 13 bp, C. elegans
tttataattcgaa

SEQ ID NO: 739492 - DNA, 13 bp, C. elegans
tttataattttcg

SEQ ID NO: 739493 - DNA, 13 bp, C. elegans
tttatacaaagtt

SEQ ID NO: 739494 - DNA, 13 bp, C. elegans
tttatacaacttt

SEQ ID NO: 739495 - DNA, 13 bp, C. elegans
tttatacatgttt

SEQ ID NO: 739496 - DNA, 13 bp, C. elegans
tttataccgattt

SEQ ID NO: 739497 - DNA, 13 bp, C. elegans
tttatagacaaaa

SEQ ID NO: 739498 - DNA, 13 bp, C. elegans
tttatagatcaaa

SEQ ID NO: 739499 - DNA, 13 bp, C. elegans
tttatagcaataa

SEQ ID NO: 739500 - DNA, 13 bp, C. elegans
tttatagctatat

SEQ ID NO: 739501 - DNA, 13 bp, C. elegans
tttatagttttcc

SEQ ID NO: 739502 - DNA, 13 bp, C. elegans
tttatatattcag

SEQ ID NO: 739503 - DNA, 13 bp, C. elegans
tttatatcaagtt

SEQ ID NO: 739504 - DNA, 13 bp, C. elegans
tttatatgaaaca

SEQ ID NO: 739505 - DNA, 13 bp, C. elegans
tttatatgcaaaa

SEQ ID NO: 739506 - DNA, 13 bp, C. elegans
tttatattccaaa

SEQ ID NO: 739507 - DNA, 13 bp, C. elegans
tttatattggaaa

SEQ ID NO: 739508 - DNA, 13 bp, C. elegans
tttatatttcaac

SEQ ID NO: 739509 - DNA, 13 bp, C. elegans
tttatatttgcaa

SEQ ID NO: 739510 - DNA, 13 bp, C. elegans
tttatcaaaaact

SEQ ID NO: 739511 - DNA, 13 bp, C. elegans
tttatcaaaaagt

SEQ ID NO: 739512 - DNA, 13 bp, C. elegans
tttatcaaaacat

SEQ ID NO: 739513 - DNA, 13 bp, C. elegans
tttatcaaaactc

SEQ ID NO: 739514 - DNA, 13 bp, C. elegans
tttatcaaaatac

SEQ ID NO: 739515 - DNA, 13 bp, C. elegans
tttatcaaatact

SEQ ID NO: 739516 - DNA, 13 bp, C. elegans
tttatcaaatcaa

SEQ ID NO: 739517 - DNA, 13 bp, C. elegans
tttatcaaatctt

SEQ ID NO: 739518 - DNA, 13 bp, C. elegans
tttatcaaatgtt

SEQ ID NO: 739519 - DNA, 13 bp, C. elegans
tttatcaaattag

SEQ ID NO: 739520 - DNA, 13 bp, C. elegans
tttatcaaatttc

SEQ ID NO: 739521 - DNA, 13 bp, C. elegans
tttatcaacaatt

SEQ ID NO: 739522 - DNA, 13 bp, C. elegans
tttatcaacattt

SEQ ID NO: 739523 - DNA, 13 bp, C. elegans
tttatcaaccaaa

SEQ ID NO: 739524 - DNA, 13 bp, C. elegans
tttatcaactatt

SEQ ID NO: 739525 - DNA, 13 bp, C. elegans
tttatcaacttta

SEQ ID NO: 739526 - DNA, 13 bp, C. elegans
tttatcaagaaat

SEQ ID NO: 739527 - DNA, 13 bp, C. elegans
tttatcaagattt

SEQ ID NO: 739528 - DNA, 13 bp, C. elegans
tttatcaagcttt

SEQ ID NO: 739529 - DNA, 13 bp, C. elegans
tttatcaataagt

SEQ ID NO: 739530 - DNA, 13 bp, C. elegans
tttatcaatttcc

SEQ ID NO: 739531 - DNA, 13 bp, C. elegans
tttatcaatttga

SEQ ID NO: 739532 - DNA, 13 bp, C. elegans
tttatcacaaata

SEQ ID NO: 739533 - DNA, 13 bp, C. elegans
tttatcacaattt

SEQ ID NO: 739534 - DNA, 13 bp, C. elegans
tttatcactaaaa

SEQ ID NO: 739535 - DNA, 13 bp, C. elegans
tttatcactgata

SEQ ID NO: 739536 - DNA, 13 bp, C. elegans
tttatcagaaaaa

SEQ ID NO: 739537 - DNA, 13 bp, C. elegans
tttatcagaaagt

SEQ ID NO: 739538 - DNA, 13 bp, C. elegans
tttatcagatttt

SEQ ID NO: 739539 - DNA, 13 bp, C. elegans
tttatcagctttt

SEQ ID NO: 739540 - DNA, 13 bp, C. elegans
tttatcagttgaa

SEQ ID NO: 739541 - DNA, 13 bp, C. elegans
tttatcagttgat

SEQ ID NO: 739542 - DNA, 13 bp, C. elegans
tttatcagttgga

SEQ ID NO: 739543 - DNA, 13 bp, C. elegans
tttatcataactt

SEQ ID NO: 739544 - DNA, 13 bp, C. elegans
tttatcatcaaat

SEQ ID NO: 739545 - DNA, 13 bp, C. elegans
tttatcattgaaa

SEQ ID NO: 739546 - DNA, 13 bp, C. elegans
tttatcatttcaa

SEQ ID NO: 739547 - DNA, 13 bp, C. elegans
tttatccaaaaaa

SEQ ID NO: 739548 - DNA, 13 bp, C. elegans
tttatccaaataa

SEQ ID NO: 739549 - DNA, 13 bp, C. elegans
tttatccgaaatt

SEQ ID NO: 739550 - DNA, 13 bp, C. elegans
tttatccgaattt

SEQ ID NO: 739551 - DNA, 13 bp, C. elegans
tttatcgaaaaaa

SEQ ID NO: 739552 - DNA, 13 bp, C. elegans
tttatcgaaaaac

SEQ ID NO: 739553 - DNA, 13 bp, C. elegans
tttatcgaaaaat

SEQ ID NO: 739554 - DNA, 13 bp, C. elegans
tttatcgaaaatt

SEQ ID NO: 739555 - DNA, 13 bp, C. elegans
tttatcgaaattt

SEQ ID NO: 739556 - DNA, 13 bp, C. elegans
tttatcgaacaaa

SEQ ID NO: 739557 - DNA, 13 bp, C. elegans
tttatcgaatttt

SEQ ID NO: 739558 - DNA, 13 bp, C. elegans
tttatcgactttt

SEQ ID NO: 739559 - DNA, 13 bp, C. elegans
tttatcgagtttt

SEQ ID NO: 739560 - DNA, 13 bp, C. elegans
tttatcgatagaa

SEQ ID NO: 739561 - DNA, 13 bp, C. elegans
tttatcgattctt

SEQ ID NO: 739562 - DNA, 13 bp, C. elegans
tttatcgatttct

SEQ ID NO: 739563 - DNA, 13 bp, C. elegans
tttatcgattttg

SEQ ID NO: 739564 - DNA, 13 bp, C. elegans
tttatctagaaaa

SEQ ID NO: 739565 - DNA, 13 bp, C. elegans
tttatctagaaat

SEQ ID NO: 739566 - DNA, 13 bp, C. elegans
tttatctcaaaaa

SEQ ID NO: 739567 - DNA, 13 bp, C. elegans
tttatctcaaaat

SEQ ID NO: 739568 - DNA, 13 bp, C. elegans
tttatctgaaaaa

SEQ ID NO: 739569 - DNA, 13 bp, C. elegans
tttatctgaaaat

SEQ ID NO: 739570 - DNA, 13 bp, C. elegans
tttatctgaaata

SEQ ID NO: 739571 - DNA, 13 bp, C. elegans
tttatctggaatt

SEQ ID NO: 739572 - DNA, 13 bp, C. elegans
tttatctgtaaaa

SEQ ID NO: 739573 - DNA, 13 bp, C. elegans
tttatcttgaaaa

SEQ ID NO: 739574 - DNA, 13 bp, C. elegans
tttatgaaaaaag

SEQ ID NO: 739575 - DNA, 13 bp, C. elegans
tttatgaaaaaga

SEQ ID NO: 739576 - DNA, 13 bp, C. elegans
tttatgaaaactc

SEQ ID NO: 739577 - DNA, 13 bp, C. elegans
tttatgaaaactt

SEQ ID NO: 739578 - DNA, 13 bp, C. elegans
tttatgaaactgt

SEQ ID NO: 739579 - DNA, 13 bp, C. elegans
tttatgaaacttt

SEQ ID NO: 739580 - DNA, 13 bp, C. elegans
tttatgaaatcaa

SEQ ID NO: 739581 - DNA, 13 bp, C. elegans
tttatgaaatctt

SEQ ID NO: 739582 - DNA, 13 bp, C. elegans
tttatgaaattgt

SEQ ID NO: 739583 - DNA, 13 bp, C. elegans
tttatgaacattt

SEQ ID NO: 739584 - DNA, 13 bp, C. elegans
tttatgaactatt

SEQ ID NO: 739585 - DNA, 13 bp, C. elegans
tttatgaagaaat

SEQ ID NO: 739586 - DNA, 13 bp, C. elegans
tttatgaagtttg

SEQ ID NO: 739587 - DNA, 13 bp, C. elegans
tttatgaatcaaa

SEQ ID NO: 739588 - DNA, 13 bp, C. elegans
tttatgacaaaaa

SEQ ID NO: 739589 - DNA, 13 bp, C. elegans
tttatgacatttt

SEQ ID NO: 739590 - DNA, 13 bp, C. elegans
tttatgacgtcat

SEQ ID NO: 739591 - DNA, 13 bp, C. elegans
tttatgagaaata

SEQ ID NO: 739592 - DNA, 13 bp, C. elegans
tttatgagaattt

SEQ ID NO: 739593 - DNA, 13 bp, C. elegans
tttatgagcattt

SEQ ID NO: 739594 - DNA, 13 bp, C. elegans
tttatgagctttt

SEQ ID NO: 739595 - DNA, 13 bp, C. elegans
tttatgaggaaaa

SEQ ID NO: 739596 - DNA, 13 bp, C. elegans
tttatgatacata

SEQ ID NO: 739597 - DNA, 13 bp, C. elegans
tttatgatacttt

SEQ ID NO: 739598 - DNA, 13 bp, C. elegans
tttatgatcaaaa

SEQ ID NO: 739599 - DNA, 13 bp, C. elegans
tttatgatgaaaa

SEQ ID NO: 739600 - DNA, 13 bp, C. elegans
tttatgcaaaaac

SEQ ID NO: 739601 - DNA, 13 bp, C. elegans
tttatgcaaatat

SEQ ID NO: 739602 - DNA, 13 bp, C. elegans
tttatgcaatatt

SEQ ID NO: 739603 - DNA, 13 bp, C. elegans
tttatgcaatttt

SEQ ID NO: 739604 - DNA, 13 bp, C. elegans
tttatgcacattt

SEQ ID NO: 739605 - DNA, 13 bp, C. elegans
tttatgccaattt

SEQ ID NO: 739606 - DNA, 13 bp, C. elegans
tttatgctaattt

SEQ ID NO: 739607 - DNA, 13 bp, C. elegans
tttatgctcattt

SEQ ID NO: 739608 - DNA, 13 bp, C. elegans
tttatgctgaaaa

SEQ ID NO: 739609 - DNA, 13 bp, C. elegans
tttatggaaaaat

SEQ ID NO: 739610 - DNA, 13 bp, C. elegans
tttatggaaaact

SEQ ID NO: 739611 - DNA, 13 bp, C. elegans
tttatggaaaatc

SEQ ID NO: 739612 - DNA, 13 bp, C. elegans
tttatggaagaaa

SEQ ID NO: 739613 - DNA, 13 bp, C. elegans
tttatggaataaa

SEQ ID NO: 739614 - DNA, 13 bp, C. elegans
tttatggattttc

SEQ ID NO: 739615 - DNA, 13 bp, C. elegans
tttatgggttttc

SEQ ID NO: 739616 - DNA, 13 bp, C. elegans
tttatgtcgattt

SEQ ID NO: 739617 - DNA, 13 bp, C. elegans
tttatgtgcaaaa

SEQ ID NO: 739618 - DNA, 13 bp, C. elegans
tttatgtgcattt

SEQ ID NO: 739619 - DNA, 13 bp, C. elegans
tttatgtggaaaa

SEQ ID NO: 739620 - DNA, 13 bp, C. elegans
tttatgttatcaa

SEQ ID NO: 739621 - DNA, 13 bp, C. elegans
tttatgttcaatt

SEQ ID NO: 739622 - DNA, 13 bp, C. elegans
tttatgttcattc

SEQ ID NO: 739623 - DNA, 13 bp, C. elegans
tttatgttcgaaa

SEQ ID NO: 739624 - DNA, 13 bp, C. elegans
tttatgttgctcg

SEQ ID NO: 739625 - DNA, 13 bp, C. elegans
tttatgtttctaa

SEQ ID NO: 739626 - DNA, 13 bp, C. elegans
tttatgtttctga

SEQ ID NO: 739627 - DNA, 13 bp, C. elegans
tttatgtttgaaa

SEQ ID NO: 739628 - DNA, 13 bp, C. elegans
tttattaaagttg

SEQ ID NO: 739629 - DNA, 13 bp, C. elegans
tttattaaattcc

SEQ ID NO: 739630 - DNA, 13 bp, C. elegans
tttattaccaaaa

SEQ ID NO: 739631 - DNA, 13 bp, C. elegans
tttattactcaaa

SEQ ID NO: 739632 - DNA, 13 bp, C. elegans
tttattagttcaa

SEQ ID NO: 739633 - DNA, 13 bp, C. elegans
tttattatggaaa

SEQ ID NO: 739634 - DNA, 13 bp, C. elegans
tttattcaaactt

SEQ ID NO: 739635 - DNA, 13 bp, C. elegans
tttattcaaatac

SEQ ID NO: 739636 - DNA, 13 bp, C. elegans
tttattcaagttt

SEQ ID NO: 739637 - DNA, 13 bp, C. elegans
tttattcaattac

SEQ ID NO: 739638 - DNA, 13 bp, C. elegans
tttattcaattga

SEQ ID NO: 739639 - DNA, 13 bp, C. elegans
tttattcacaata

SEQ ID NO: 739640 - DNA, 13 bp, C. elegans
tttattcagaaaa

SEQ ID NO: 739641 - DNA, 13 bp, C. elegans
tttattcagataa

SEQ ID NO: 739642 - DNA, 13 bp, C. elegans
tttattcatcaaa

SEQ ID NO: 739643 - DNA, 13 bp, C. elegans
tttattcatgaaa

SEQ ID NO: 739644 - DNA, 13 bp, C. elegans
tttattccaaaaa

SEQ ID NO: 739645 - DNA, 13 bp, C. elegans
tttattccaataa

SEQ ID NO: 739646 - DNA, 13 bp, C. elegans
tttattccagaat

SEQ ID NO: 739647 - DNA, 13 bp, C. elegans
tttattccataaa

SEQ ID NO: 739648 - DNA, 13 bp, C. elegans
tttattccgaaat

SEQ ID NO: 739649 - DNA, 13 bp, C. elegans
tttattcgaatat

SEQ ID NO: 739650 - DNA, 13 bp, C. elegans
tttattcgataaa

SEQ ID NO: 739651 - DNA, 13 bp, C. elegans
tttattcggatgg

SEQ ID NO: 739652 - DNA, 13 bp, C. elegans
tttattcggattt

SEQ ID NO: 739653 - DNA, 13 bp, C. elegans
tttattctacaaa

SEQ ID NO: 739654 - DNA, 13 bp, C. elegans
tttattctcgaaa

SEQ ID NO: 739655 - DNA, 13 bp, C. elegans
tttattctgataa

SEQ ID NO: 739656 - DNA, 13 bp, C. elegans
tttattctgcaaa

SEQ ID NO: 739657 - DNA, 13 bp, C. elegans
tttattcttcaaa

SEQ ID NO: 739658 - DNA, 13 bp, C. elegans
tttattcttgaaa

SEQ ID NO: 739659 - DNA, 13 bp, C. elegans
tttattgaaaaac

SEQ ID NO: 739660 - DNA, 13 bp, C. elegans
tttattgaaaaag

SEQ ID NO: 739661 - DNA, 13 bp, C. elegans
tttattgaaaact

SEQ ID NO: 739662 - DNA, 13 bp, C. elegans
tttattgaaaagt

SEQ ID NO: 739663 - DNA, 13 bp, C. elegans
tttattgaaacgt

SEQ ID NO: 739664 - DNA, 13 bp, C. elegans
tttattgaaattc

SEQ ID NO: 739665 - DNA, 13 bp, C. elegans
tttattgaatgaa

SEQ ID NO: 739666 - DNA, 13 bp, C. elegans
tttattgacaaaa

SEQ ID NO: 739667 - DNA, 13 bp, C. elegans
tttattgatttca

SEQ ID NO: 739668 - DNA, 13 bp, C. elegans
tttattgcaaata

SEQ ID NO: 739669 - DNA, 13 bp, C. elegans
tttattgcaaatt

SEQ ID NO: 739670 - DNA, 13 bp, C. elegans
tttattgcaatta

SEQ ID NO: 739671 - DNA, 13 bp, C. elegans
tttattgcaattc

SEQ ID NO: 739672 - DNA, 13 bp, C. elegans
tttattgcacatt

SEQ ID NO: 739673 - DNA, 13 bp, C. elegans
tttattgcagttt

SEQ ID NO: 739674 - DNA, 13 bp, C. elegans
tttattgcatatt

SEQ ID NO: 739675 - DNA, 13 bp, C. elegans
tttattgcattct

SEQ ID NO: 739676 - DNA, 13 bp, C. elegans
tttattgcatttg

SEQ ID NO: 739677 - DNA, 13 bp, C. elegans
tttattgccaaat

SEQ ID NO: 739678 - DNA, 13 bp, C. elegans
tttattgccattt

SEQ ID NO: 739679 - DNA, 13 bp, C. elegans
tttattgcttcaa

SEQ ID NO: 739680 - DNA, 13 bp, C. elegans
tttattgctttaa

SEQ ID NO: 739681 - DNA, 13 bp, C. elegans
tttattggaaaat

SEQ ID NO: 739682 - DNA, 13 bp, C. elegans
tttattggaaaga

SEQ ID NO: 739683 - DNA, 13 bp, C. elegans
tttattggaaatt

SEQ ID NO: 739684 - DNA, 13 bp, C. elegans
tttattggaattc

SEQ ID NO: 739685 - DNA, 13 bp, C. elegans
tttattggtttca

SEQ ID NO: 739686 - DNA, 13 bp, C. elegans
tttattgtattca

SEQ ID NO: 739687 - DNA, 13 bp, C. elegans
tttattgtcaaaa

SEQ ID NO: 739688 - DNA, 13 bp, C. elegans
tttattgtcaaat

SEQ ID NO: 739689 - DNA, 13 bp, C. elegans
tttattgtgaaaa

SEQ ID NO: 739690 - DNA, 13 bp, C. elegans
tttattgttccaa

SEQ ID NO: 739691 - DNA, 13 bp, C. elegans
tttattgttgaaa

SEQ ID NO: 739692 - DNA, 13 bp, C. elegans
tttattgtttcag

SEQ ID NO: 739693 - DNA, 13 bp, C. elegans
tttatttaaaacc

SEQ ID NO: 739694 - DNA, 14 bp, C. elegans
tttatttatcagtt

SEQ ID NO: 739695 - DNA, 13 bp, C. elegans
tttatttcaaact

SEQ ID NO: 739696 - DNA, 13 bp, C. elegans
tttatttcaagta

SEQ ID NO: 739697 - DNA, 13 bp, C. elegans
tttatttcaagtt

SEQ ID NO: 739698 - DNA, 13 bp, C. elegans
tttatttcaattg

SEQ ID NO: 739699 - DNA, 13 bp, C. elegans
tttatttcacaac

SEQ ID NO: 739700 - DNA, 13 bp, C. elegans
tttatttcagttg

SEQ ID NO: 739701 - DNA, 13 bp, C. elegans
tttatttcgaaaa

SEQ ID NO: 739702 - DNA, 13 bp, C. elegans
tttatttcgaaga

SEQ ID NO: 739703 - DNA, 13 bp, C. elegans
tttatttctaaac

SEQ ID NO: 739704 - DNA, 13 bp, C. elegans
tttatttctcaca

SEQ ID NO: 739705 - DNA, 13 bp, C. elegans
tttatttctccaa

SEQ ID NO: 739706 - DNA, 13 bp, C. elegans
tttatttctgaaa

SEQ ID NO: 739707 - DNA, 13 bp, C. elegans
tttatttgaaaca

SEQ ID NO: 739708 - DNA, 13 bp, C. elegans
tttatttgaacat

SEQ ID NO: 739709 - DNA, 13 bp, C. elegans
tttatttgaagaa

SEQ ID NO: 739710 - DNA, 13 bp, C. elegans
tttatttgaattc

SEQ ID NO: 739711 - DNA, 13 bp, C. elegans
tttatttgataca

SEQ ID NO: 739712 - DNA, 13 bp, C. elegans
tttatttgcaaaa

SEQ ID NO: 739713 - DNA, 13 bp, C. elegans
tttatttggaaaa

SEQ ID NO: 739714 - DNA, 13 bp, C. elegans
tttatttggaaat

SEQ ID NO: 739715 - DNA, 13 bp, C. elegans
tttatttggaaga

SEQ ID NO: 739716 - DNA, 13 bp, C. elegans
tttatttgtgaaa

SEQ ID NO: 739717 - DNA, 13 bp, C. elegans
tttatttgttcaa

SEQ ID NO: 739718 - DNA, 13 bp, C. elegans
tttattttacagt

SEQ ID NO: 739719 - DNA, 13 bp, C. elegans
tttattttagaac

SEQ ID NO: 739720 - DNA, 13 bp, C. elegans
tttattttaggaa

SEQ ID NO: 739721 - DNA, 13 bp, C. elegans
tttattttcaaac

SEQ ID NO: 739722 - DNA, 13 bp, C. elegans
tttattttcaaag

SEQ ID NO: 739723 - DNA, 13 bp, C. elegans
tttattttcagcc

SEQ ID NO: 739724 - DNA, 13 bp, C. elegans
tttattttccgaa

SEQ ID NO: 739725 - DNA, 13 bp, C. elegans
tttattttccgat

SEQ ID NO: 739726 - DNA, 13 bp, C. elegans
tttattttcgaaa

SEQ ID NO: 739727 - DNA, 13 bp, C. elegans
tttattttcgaat

SEQ ID NO: 739728 - DNA, 13 bp, C. elegans
tttattttcgata

SEQ ID NO: 739729 - DNA, 13 bp, C. elegans
tttattttctcag

SEQ ID NO: 739730 - DNA, 13 bp, C. elegans
tttattttgaaac

SEQ ID NO: 739731 - DNA, 13 bp, C. elegans
tttattttgagaa

SEQ ID NO: 739732 - DNA, 13 bp, C. elegans
tttattttgagtc

SEQ ID NO: 739733 - DNA, 13 bp, C. elegans
tttattttgcaac

SEQ ID NO: 739734 - DNA, 13 bp, C. elegans
tttattttgcata

SEQ ID NO: 739735 - DNA, 13 bp, C. elegans
tttattttggaaa

SEQ ID NO: 739736 - DNA, 13 bp, C. elegans
tttattttggaag

SEQ ID NO: 739737 - DNA, 14 bp, C. elegans
tttatttttcaagt

SEQ ID NO: 739738 - DNA, 13 bp, C. elegans
tttatttttcgag

SEQ ID NO: 739739 - DNA, 13 bp, C. elegans
tttatttttcgga

SEQ ID NO: 739740 - DNA, 13 bp, C. elegans
tttatttttgaac

SEQ ID NO: 739741 - DNA, 13 bp, C. elegans
tttcaaaaaaagc

SEQ ID NO: 739742 - DNA, 13 bp, C. elegans
tttcaaaaaaagt

SEQ ID NO: 739743 - DNA, 13 bp, C. elegans
tttcaaaaaacac

SEQ ID NO: 739744 - DNA, 13 bp, C. elegans
tttcaaaaaacat

SEQ ID NO: 739745 - DNA, 13 bp, C. elegans
tttcaaaaaacgc

SEQ ID NO: 739746 - DNA, 13 bp, C. elegans
tttcaaaaaacgg

SEQ ID NO: 739747 - DNA, 13 bp, C. elegans
tttcaaaaaactt

SEQ ID NO: 739748 - DNA, 13 bp, C. elegans
tttcaaaaaagct

SEQ ID NO: 739749 - DNA, 13 bp, C. elegans
tttcaaaaaagtg

SEQ ID NO: 739750 - DNA, 13 bp, C. elegans
tttcaaaaaatcc

SEQ ID NO: 739751 - DNA, 13 bp, C. elegans
tttcaaaaaatct

SEQ ID NO: 739752 - DNA, 13 bp, C. elegans
tttcaaaaaatgt

SEQ ID NO: 739753 - DNA, 13 bp, C. elegans
tttcaaaaacagt

SEQ ID NO: 739754 - DNA, 13 bp, C. elegans
tttcaaaaaccat

SEQ ID NO: 739755 - DNA, 13 bp, C. elegans
tttcaaaaaccga

SEQ ID NO: 739756 - DNA, 13 bp, C. elegans
tttcaaaaactac

SEQ ID NO: 739757 - DNA, 13 bp, C. elegans
tttcaaaaactgt

SEQ ID NO: 739758 - DNA, 13 bp, C. elegans
tttcaaaaacttc

SEQ ID NO: 739759 - DNA, 13 bp, C. elegans
tttcaaaaacttt

SEQ ID NO: 739760 - DNA, 13 bp, C. elegans
tttcaaaaagaaa

SEQ ID NO: 739761 - DNA, 13 bp, C. elegans
tttcaaaaagata

SEQ ID NO: 739762 - DNA, 13 bp, C. elegans
tttcaaaaagatt

SEQ ID NO: 739763 - DNA, 13 bp, C. elegans
tttcaaaaagctt

SEQ ID NO: 739764 - DNA, 13 bp, C. elegans
tttcaaaaaggaa

SEQ ID NO: 739765 - DNA, 13 bp, C. elegans
tttcaaaaaggca

SEQ ID NO: 739766 - DNA, 13 bp, C. elegans
tttcaaaaagtga

SEQ ID NO: 739767 - DNA, 13 bp, C. elegans
tttcaaaaataac

SEQ ID NO: 739768 - DNA, 13 bp, C. elegans
tttcaaaaataag

SEQ ID NO: 739769 - DNA, 13 bp, C. elegans
tttcaaaaatact

SEQ ID NO: 739770 - DNA, 13 bp, C. elegans
tttcaaaaatatc

SEQ ID NO: 739771 - DNA, 14 bp, C. elegans
tttcaaaaatcgat

SEQ ID NO: 739772 - DNA, 13 bp, C. elegans
tttcaaaaatcgc

SEQ ID NO: 739773 - DNA, 13 bp, C. elegans
tttcaaaaatctt

SEQ ID NO: 739774 - DNA, 13 bp, C. elegans
tttcaaaaatgca

SEQ ID NO: 739775 - DNA, 13 bp, C. elegans
tttcaaaaatgct

SEQ ID NO: 739776 - DNA, 13 bp, C. elegans
tttcaaaaatgtc

SEQ ID NO: 739777 - DNA, 13 bp, C. elegans
tttcaaaaatgtt

SEQ ID NO: 739778 - DNA, 13 bp, C. elegans
tttcaaaaattac

SEQ ID NO: 739779 - DNA, 13 bp, C. elegans
tttcaaaaattca

SEQ ID NO: 739780 - DNA, 13 bp, C. elegans
tttcaaaaattga

SEQ ID NO: 739781 - DNA, 13 bp, C. elegans
tttcaaaaattgt

SEQ ID NO: 739782 - DNA, 13 bp, C. elegans
tttcaaaaatttg

SEQ ID NO: 739783 - DNA, 13 bp, C. elegans
tttcaaaacaaat

SEQ ID NO: 739784 - DNA, 13 bp, C. elegans
tttcaaaacaaca

SEQ ID NO: 739785 - DNA, 13 bp, C. elegans
tttcaaaacaatg

SEQ ID NO: 739786 - DNA, 13 bp, C. elegans
tttcaaaacaatt

SEQ ID NO: 739787 - DNA, 13 bp, C. elegans
tttcaaaacatgt

SEQ ID NO: 739788 - DNA, 13 bp, C. elegans
tttcaaaacatta

SEQ ID NO: 739789 - DNA, 13 bp, C. elegans
tttcaaaacattt

SEQ ID NO: 739790 - DNA, 13 bp, C. elegans
tttcaaaacgaat

SEQ ID NO: 739791 - DNA, 13 bp, C. elegans
tttcaaaacgatt

SEQ ID NO: 739792 - DNA, 13 bp, C. elegans
tttcaaaacggaa

SEQ ID NO: 739793 - DNA, 13 bp, C. elegans
tttcaaaactcca

SEQ ID NO: 739794 - DNA, 13 bp, C. elegans
tttcaaaactctc

SEQ ID NO: 739795 - DNA, 13 bp, C. elegans
tttcaaaactctt

SEQ ID NO: 739796 - DNA, 13 bp, C. elegans
tttcaaaactgtt

SEQ ID NO: 739797 - DNA, 13 bp, C. elegans
tttcaaaacttcc

SEQ ID NO: 739798 - DNA, 13 bp, C. elegans
tttcaaaacttct

SEQ ID NO: 739799 - DNA, 13 bp, C. elegans
tttcaaaacttga

SEQ ID NO: 739800 - DNA, 13 bp, C. elegans
tttcaaaacttta

SEQ ID NO: 739801 - DNA, 13 bp, C. elegans
tttcaaaactttc

SEQ ID NO: 739802 - DNA, 13 bp, C. elegans
tttcaaaactttg

SEQ ID NO: 739803 - DNA, 13 bp, C. elegans
tttcaaaagaaat

SEQ ID NO: 739804 - DNA, 13 bp, C. elegans
tttcaaaagattt

SEQ ID NO: 739805 - DNA, 13 bp, C. elegans
tttcaaaagctct

SEQ ID NO: 739806 - DNA, 13 bp, C. elegans
tttcaaaagcttc

SEQ ID NO: 739807 - DNA, 13 bp, C. elegans
tttcaaaagcttt

SEQ ID NO: 739808 - DNA, 13 bp, C. elegans
tttcaaaaggatt

SEQ ID NO: 739809 - DNA, 13 bp, C. elegans
tttcaaaagtatt

SEQ ID NO: 739810 - DNA, 13 bp, C. elegans
tttcaaaagttgg

SEQ ID NO: 739811 - DNA, 13 bp, C. elegans
tttcaaaagttta

SEQ ID NO: 739812 - DNA, 13 bp, C. elegans
tttcaaaataaga

SEQ ID NO: 739813 - DNA, 13 bp, C. elegans
tttcaaaatactt

SEQ ID NO: 739814 - DNA, 13 bp, C. elegans
tttcaaaatatag

SEQ ID NO: 739815 - DNA, 13 bp, C. elegans
tttcaaaatatcc

SEQ ID NO: 739816 - DNA, 13 bp, C. elegans
tttcaaaatatcg

SEQ ID NO: 739817 - DNA, 13 bp, C. elegans
tttcaaaatattg

SEQ ID NO: 739818 - DNA, 13 bp, C. elegans
tttcaaaatcaaa

SEQ ID NO: 739819 - DNA, 13 bp, C. elegans
tttcaaaatcaag

SEQ ID NO: 739820 - DNA, 13 bp, C. elegans
tttcaaaatcaat

SEQ ID NO: 739821 - DNA, 13 bp, C. elegans
tttcaaaatcaga

SEQ ID NO: 739822 - DNA, 13 bp, C. elegans
tttcaaaatcatt

SEQ ID NO: 739823 - DNA, 13 bp, C. elegans
tttcaaaatccgg

SEQ ID NO: 739824 - DNA, 13 bp, C. elegans
tttcaaaatcctt

SEQ ID NO: 739825 - DNA, 13 bp, C. elegans
tttcaaaatcgtc

SEQ ID NO: 739826 - DNA, 13 bp, C. elegans
tttcaaaatctac

SEQ ID NO: 739827 - DNA, 13 bp, C. elegans
tttcaaaatctca

SEQ ID NO: 739828 - DNA, 13 bp, C. elegans
tttcaaaatctga

SEQ ID NO: 739829 - DNA, 13 bp, C. elegans
tttcaaaatgata

SEQ ID NO: 739830 - DNA, 13 bp, C. elegans
tttcaaaatgtct

SEQ ID NO: 739831 - DNA, 13 bp, C. elegans
tttcaaaatgtgg

SEQ ID NO: 739832 - DNA, 13 bp, C. elegans
tttcaaaatgtgt

SEQ ID NO: 739833 - DNA, 13 bp, C. elegans
tttcaaaattaga

SEQ ID NO: 739834 - DNA, 13 bp, C. elegans
tttcaaaattatc

SEQ ID NO: 739835 - DNA, 13 bp, C. elegans
tttcaaaattatg

SEQ ID NO: 739836 - DNA, 13 bp, C. elegans
tttcaaaattcaa

SEQ ID NO: 739837 - DNA, 13 bp, C. elegans
tttcaaaattcca

SEQ ID NO: 739838 - DNA, 13 bp, C. elegans
tttcaaaattcga

SEQ ID NO: 739839 - DNA, 13 bp, C. elegans
tttcaaaattcgc

SEQ ID NO: 739840 - DNA, 13 bp, C. elegans
tttcaaaattcta

SEQ ID NO: 739841 - DNA, 13 bp, C. elegans
tttcaaaattctt

SEQ ID NO: 739842 - DNA, 13 bp, C. elegans
tttcaaaattgaa

SEQ ID NO: 739843 - DNA, 13 bp, C. elegans
tttcaaaattgta

SEQ ID NO: 739844 - DNA, 13 bp, C. elegans
tttcaaaatttca

SEQ ID NO: 739845 - DNA, 13 bp, C. elegans
tttcaaaatttcc

SEQ ID NO: 739846 - DNA, 13 bp, C. elegans
tttcaaaatttga

SEQ ID NO: 739847 - DNA, 13 bp, C. elegans
tttcaaaatttgt

SEQ ID NO: 739848 - DNA, 13 bp, C. elegans
tttcaaacaaaac

SEQ ID NO: 739849 - DNA, 13 bp, C. elegans
tttcaaacaaaat

SEQ ID NO: 739850 - DNA, 13 bp, C. elegans
tttcaaacaaaca

SEQ ID NO: 739851 - DNA, 13 bp, C. elegans
tttcaaacaaatt

SEQ ID NO: 739852 - DNA, 13 bp, C. elegans
tttcaaacaacaa

SEQ ID NO: 739853 - DNA, 13 bp, C. elegans
tttcaaacaagaa

SEQ ID NO: 739854 - DNA, 13 bp, C. elegans
tttcaaacaatga

SEQ ID NO: 739855 - DNA, 13 bp, C. elegans
tttcaaacaatgt

SEQ ID NO: 739856 - DNA, 13 bp, C. elegans
tttcaaacaattt

SEQ ID NO: 739857 - DNA, 13 bp, C. elegans
tttcaaacacaat

SEQ ID NO: 739858 - DNA, 13 bp, C. elegans
tttcaaacacttt

SEQ ID NO: 739859 - DNA, 13 bp, C. elegans
tttcaaacagaaa

SEQ ID NO: 739860 - DNA, 13 bp, C. elegans
tttcaaacagatt

SEQ ID NO: 739861 - DNA, 13 bp, C. elegans
tttcaaacagtaa

SEQ ID NO: 739862 - DNA, 13 bp, C. elegans
tttcaaacagttt

SEQ ID NO: 739863 - DNA, 13 bp, C. elegans
tttcaaacattct

SEQ ID NO: 739864 - DNA, 13 bp, C. elegans
tttcaaacattta

SEQ ID NO: 739865 - DNA, 13 bp, C. elegans
tttcaaacatttc

SEQ ID NO: 739866 - DNA, 13 bp, C. elegans
tttcaaacatttt

SEQ ID NO: 739867 - DNA, 13 bp, C. elegans
tttcaaaccaaaa

SEQ ID NO: 739868 - DNA, 13 bp, C. elegans
tttcaaaccacaa

SEQ ID NO: 739869 - DNA, 13 bp, C. elegans
tttcaaaccgttt

SEQ ID NO: 739870 - DNA, 13 bp, C. elegans
tttcaaacggttt

SEQ ID NO: 739871 - DNA, 13 bp, C. elegans
tttcaaacgtttc

SEQ ID NO: 739872 - DNA, 13 bp, C. elegans
tttcaaacgtttt

SEQ ID NO: 739873 - DNA, 13 bp, C. elegans
tttcaaactaaat

SEQ ID NO: 739874 - DNA, 13 bp, C. elegans
tttcaaactattt

SEQ ID NO: 739875 - DNA, 13 bp, C. elegans
tttcaaactcaat

SEQ ID NO: 739876 - DNA, 13 bp, C. elegans
tttcaaactctct

SEQ ID NO: 739877 - DNA, 13 bp, C. elegans
tttcaaactctta

SEQ ID NO: 739878 - DNA, 13 bp, C. elegans
tttcaaactcttc

SEQ ID NO: 739879 - DNA, 13 bp, C. elegans
tttcaaactgaaa

SEQ ID NO: 739880 - DNA, 13 bp, C. elegans
tttcaaactgttt

SEQ ID NO: 739881 - DNA, 13 bp, C. elegans
tttcaaacttaaa

SEQ ID NO: 739882 - DNA, 13 bp, C. elegans
tttcaaacttaca

SEQ ID NO: 739883 - DNA, 13 bp, C. elegans
tttcaaacttcaa

SEQ ID NO: 739884 - DNA, 13 bp, C. elegans
tttcaaacttcta

SEQ ID NO: 739885 - DNA, 13 bp, C. elegans
tttcaaactttaa

SEQ ID NO: 739886 - DNA, 13 bp, C. elegans
tttcaaactttca

SEQ ID NO: 739887 - DNA, 13 bp, C. elegans
tttcaaactttct

SEQ ID NO: 739888 - DNA, 13 bp, C. elegans
tttcaaacttttg

SEQ ID NO: 739889 - DNA, 13 bp, C. elegans
tttcaaagaaaaa

SEQ ID NO: 739890 - DNA, 13 bp, C. elegans
tttcaaagaaaat

SEQ ID NO: 739891 - DNA, 13 bp, C. elegans
tttcaaagaaata

SEQ ID NO: 739892 - DNA, 13 bp, C. elegans
tttcaaagaacaa

SEQ ID NO: 739893 - DNA, 13 bp, C. elegans
tttcaaagaatct

SEQ ID NO: 739894 - DNA, 13 bp, C. elegans
tttcaaagacttc

SEQ ID NO: 739895 - DNA, 13 bp, C. elegans
tttcaaagagaaa

SEQ ID NO: 739896 - DNA, 13 bp, C. elegans
tttcaaagatcta

SEQ ID NO: 739897 - DNA, 13 bp, C. elegans
tttcaaagatctt

SEQ ID NO: 739898 - DNA, 13 bp, C. elegans
tttcaaagatgaa

SEQ ID NO: 739899 - DNA, 13 bp, C. elegans
tttcaaagattaa

SEQ ID NO: 739900 - DNA, 13 bp, C. elegans
tttcaaagattta

SEQ ID NO: 739901 - DNA, 13 bp, C. elegans
tttcaaagatttc

SEQ ID NO: 739902 - DNA, 13 bp, C. elegans
tttcaaagatttt

SEQ ID NO: 739903 - DNA, 13 bp, C. elegans
tttcaaagcaaaa

SEQ ID NO: 739904 - DNA, 13 bp, C. elegans
tttcaaagcaaca

SEQ ID NO: 739905 - DNA, 13 bp, C. elegans
tttcaaagcagaa

SEQ ID NO: 739906 - DNA, 13 bp, C. elegans
tttcaaaggaaca

SEQ ID NO: 739907 - DNA, 13 bp, C. elegans
tttcaaaggaatt

SEQ ID NO: 739908 - DNA, 13 bp, C. elegans
tttcaaagtattc

SEQ ID NO: 739909 - DNA, 13 bp, C. elegans
tttcaaagtattt

SEQ ID NO: 739910 - DNA, 13 bp, C. elegans
tttcaaagtcaag

SEQ ID NO: 739911 - DNA, 13 bp, C. elegans
tttcaaagtgaaa

SEQ ID NO: 739912 - DNA, 13 bp, C. elegans
tttcaaagtggaa

SEQ ID NO: 739913 - DNA, 13 bp, C. elegans
tttcaaagtgttt

SEQ ID NO: 739914 - DNA, 13 bp, C. elegans
tttcaaagttaaa

SEQ ID NO: 739915 - DNA, 13 bp, C. elegans
tttcaaagttaag

SEQ ID NO: 739916 - DNA, 13 bp, C. elegans
tttcaaagttacg

SEQ ID NO: 739917 - DNA, 13 bp, C. elegans
tttcaaagttatc

SEQ ID NO: 739918 - DNA, 13 bp, C. elegans
tttcaaagttatt

SEQ ID NO: 739919 - DNA, 13 bp, C. elegans
tttcaaagttcta

SEQ ID NO: 739920 - DNA, 13 bp, C. elegans
tttcaaagttctc

SEQ ID NO: 739921 - DNA, 13 bp, C. elegans
tttcaaagttctt

SEQ ID NO: 739922 - DNA, 13 bp, C. elegans
tttcaaagttgtg

SEQ ID NO: 739923 - DNA, 13 bp, C. elegans
tttcaaagtttat

SEQ ID NO: 739924 - DNA, 13 bp, C. elegans
tttcaaagtttgg

SEQ ID NO: 739925 - DNA, 13 bp, C. elegans
tttcaaagtttta

SEQ ID NO: 739926 - DNA, 13 bp, C. elegans
tttcaaataacat

SEQ ID NO: 739927 - DNA, 13 bp, C. elegans
tttcaaataactt

SEQ ID NO: 739928 - DNA, 13 bp, C. elegans
tttcaaatacaaa

SEQ ID NO: 739929 - DNA, 13 bp, C. elegans
tttcaaatacaat

SEQ ID NO: 739930 - DNA, 13 bp, C. elegans
tttcaaatacatt

SEQ ID NO: 739931 - DNA, 13 bp, C. elegans
tttcaaatactct

SEQ ID NO: 739932 - DNA, 13 bp, C. elegans
tttcaaatacttc

SEQ ID NO: 739933 - DNA, 13 bp, C. elegans
tttcaaatagaaa

SEQ ID NO: 739934 - DNA, 13 bp, C. elegans
tttcaaatagtaa

SEQ ID NO: 739935 - DNA, 13 bp, C. elegans
tttcaaatagttg

SEQ ID NO: 739936 - DNA, 13 bp, C. elegans
tttcaaatagttt

SEQ ID NO: 739937 - DNA, 13 bp, C. elegans
tttcaaatattca

SEQ ID NO: 739938 - DNA, 13 bp, C. elegans
tttcaaatatttc

SEQ ID NO: 739939 - DNA, 13 bp, C. elegans
tttcaaatatttg

SEQ ID NO: 739940 - DNA, 13 bp, C. elegans
tttcaaatcaaaa

SEQ ID NO: 739941 - DNA, 13 bp, C. elegans
tttcaaatcaagt

SEQ ID NO: 739942 - DNA, 13 bp, C. elegans
tttcaaatcaatt

SEQ ID NO: 739943 - DNA, 15 bp, C. elegans
tttcaaatcacgaaa

SEQ ID NO: 739944 - DNA, 13 bp, C. elegans
tttcaaatcattt

SEQ ID NO: 739945 - DNA, 13 bp, C. elegans
tttcaaatcggaa

SEQ ID NO: 739946 - DNA, 13 bp, C. elegans
tttcaaatctaaa

SEQ ID NO: 739947 - DNA, 13 bp, C. elegans
tttcaaatctcat

SEQ ID NO: 739948 - DNA, 13 bp, C. elegans
tttcaaatctgtt

SEQ ID NO: 739949 - DNA, 13 bp, C. elegans
tttcaaatgaaat

SEQ ID NO: 739950 - DNA, 13 bp, C. elegans
tttcaaatgaatt

SEQ ID NO: 739951 - DNA, 13 bp, C. elegans
tttcaaatgatca

SEQ ID NO: 739952 - DNA, 13 bp, C. elegans
tttcaaatgcaaa

SEQ ID NO: 739953 - DNA, 13 bp, C. elegans
tttcaaatgctca

SEQ ID NO: 739954 - DNA, 13 bp, C. elegans
tttcaaatggaat

SEQ ID NO: 739955 - DNA, 13 bp, C. elegans
tttcaaatggcat

SEQ ID NO: 739956 - DNA, 13 bp, C. elegans
tttcaaatgtaca

SEQ ID NO: 739957 - DNA, 13 bp, C. elegans
tttcaaatgtatt

SEQ ID NO: 739958 - DNA, 13 bp, C. elegans
tttcaaatgtgta

SEQ ID NO: 739959 - DNA, 13 bp, C. elegans
tttcaaatgtgtt

SEQ ID NO: 739960 - DNA, 13 bp, C. elegans
tttcaaatgttct

SEQ ID NO: 739961 - DNA, 14 bp, C. elegans
tttcaaatgttttc

SEQ ID NO: 739962 - DNA, 13 bp, C. elegans
tttcaaattacag

SEQ ID NO: 739963 - DNA, 13 bp, C. elegans
tttcaaattactt

SEQ ID NO: 739964 - DNA, 13 bp, C. elegans
tttcaaattatag

SEQ ID NO: 739965 - DNA, 13 bp, C. elegans
tttcaaattatcg

SEQ ID NO: 739966 - DNA, 13 bp, C. elegans
tttcaaattcata

SEQ ID NO: 739967 - DNA, 13 bp, C. elegans
tttcaaattcatt

SEQ ID NO: 739968 - DNA, 13 bp, C. elegans
tttcaaattccaa

SEQ ID NO: 739969 - DNA, 13 bp, C. elegans
tttcaaattccac

SEQ ID NO: 739970 - DNA, 13 bp, C. elegans
tttcaaattctca

SEQ ID NO: 739971 - DNA, 13 bp, C. elegans
tttcaaattctgg

SEQ ID NO: 739972 - DNA, 13 bp, C. elegans
tttcaaattcttc

SEQ ID NO: 739973 - DNA, 13 bp, C. elegans
tttcaaattgaac

SEQ ID NO: 739974 - DNA, 13 bp, C. elegans
tttcaaattgatt

SEQ ID NO: 739975 - DNA, 13 bp, C. elegans
tttcaaattgcat

SEQ ID NO: 739976 - DNA, 13 bp, C. elegans
tttcaaattggaa

SEQ ID NO: 739977 - DNA, 13 bp, C. elegans
tttcaaattggat

SEQ ID NO: 739978 - DNA, 13 bp, C. elegans
tttcaaattggtt

SEQ ID NO: 739979 - DNA, 13 bp, C. elegans
tttcaaattgtat

SEQ ID NO: 739980 - DNA, 13 bp, C. elegans
tttcaaattgtga

SEQ ID NO: 739981 - DNA, 13 bp, C. elegans
tttcaaattgttt

SEQ ID NO: 739982 - DNA, 13 bp, C. elegans
tttcaaatttaac

SEQ ID NO: 739983 - DNA, 13 bp, C. elegans
tttcaaatttaca

SEQ ID NO: 739984 - DNA, 13 bp, C. elegans
tttcaaatttagt

SEQ ID NO: 739985 - DNA, 13 bp, C. elegans
tttcaaatttatc

SEQ ID NO: 739986 - DNA, 13 bp, C. elegans
tttcaaatttatg

SEQ ID NO: 739987 - DNA, 13 bp, C. elegans
tttcaaatttcag

SEQ ID NO: 739988 - DNA, 13 bp, C. elegans
tttcaaatttcat

SEQ ID NO: 739989 - DNA, 13 bp, C. elegans
tttcaaatttcgg

SEQ ID NO: 739990 - DNA, 13 bp, C. elegans
tttcaaatttctc

SEQ ID NO: 739991 - DNA, 13 bp, C. elegans
tttcaaatttctg

SEQ ID NO: 739992 - DNA, 13 bp, C. elegans
tttcaaatttgat

SEQ ID NO: 739993 - DNA, 13 bp, C. elegans
tttcaaatttgtg

SEQ ID NO: 739994 - DNA, 13 bp, C. elegans
tttcaaattttca

SEQ ID NO: 739995 - DNA, 13 bp, C. elegans
tttcaaattttga

SEQ ID NO: 739996 - DNA, 13 bp, C. elegans
tttcaaattttgg

SEQ ID NO: 739997 - DNA, 13 bp, C. elegans
tttcaaattttgt

SEQ ID NO: 739998 - DNA, 13 bp, C. elegans
tttcaaatttttg

SEQ ID NO: 739999 - DNA, 13 bp, C. elegans
tttcaacaaaaat

SEQ ID NO: 740000 - DNA, 13 bp, C. elegans
tttcaacaaaatt

SEQ ID NO: 740001 - DNA, 13 bp, C. elegans
tttcaacaaagat

SEQ ID NO: 740002 - DNA, 13 bp, C. elegans
tttcaacaaatat

SEQ ID NO: 740003 - DNA, 13 bp, C. elegans
tttcaacaaatgt

SEQ ID NO: 740004 - DNA, 13 bp, C. elegans
tttcaacaaatta

SEQ ID NO: 740005 - DNA, 13 bp, C. elegans
tttcaacaaattt

SEQ ID NO: 740006 - DNA, 13 bp, C. elegans
tttcaacaacatt

SEQ ID NO: 740007 - DNA, 13 bp, C. elegans
tttcaacaacttt

SEQ ID NO: 740008 - DNA, 13 bp, C. elegans
tttcaacaagaaa

SEQ ID NO: 740009 - DNA, 13 bp, C. elegans
tttcaacaagaat

SEQ ID NO: 740010 - DNA, 13 bp, C. elegans
tttcaacaagttt

SEQ ID NO: 740011 - DNA, 13 bp, C. elegans
tttcaacaatgat

SEQ ID NO: 740012 - DNA, 13 bp, C. elegans
tttcaacaatttc

SEQ ID NO: 740013 - DNA, 13 bp, C. elegans
tttcaacacaaaa

SEQ ID NO: 740014 - DNA, 13 bp, C. elegans
tttcaacacttta

SEQ ID NO: 740015 - DNA, 13 bp, C. elegans
tttcaacagaaaa

SEQ ID NO: 740016 - DNA, 13 bp, C. elegans
tttcaacagtttc

SEQ ID NO: 740017 - DNA, 13 bp, C. elegans
tttcaacatgttt

SEQ ID NO: 740018 - DNA, 13 bp, C. elegans
tttcaacattgaa

SEQ ID NO: 740019 - DNA, 13 bp, C. elegans
tttcaacattgta

SEQ ID NO: 740020 - DNA, 13 bp, C. elegans
tttcaacatttca

SEQ ID NO: 740021 - DNA, 13 bp, C. elegans
tttcaacatttgc

SEQ ID NO: 740022 - DNA, 13 bp, C. elegans
tttcaacattttc

SEQ ID NO: 740023 - DNA, 13 bp, C. elegans
tttcaaccaactt

SEQ ID NO: 740024 - DNA, 13 bp, C. elegans
tttcaaccaatca

SEQ ID NO: 740025 - DNA, 13 bp, C. elegans
tttcaaccagttt

SEQ ID NO: 740026 - DNA, 13 bp, C. elegans
tttcaaccatttt

SEQ ID NO: 740027 - DNA, 13 bp, C. elegans
tttcaacccaaaa

SEQ ID NO: 740028 - DNA, 13 bp, C. elegans
tttcaaccgaaaa

SEQ ID NO: 740029 - DNA, 13 bp, C. elegans
tttcaacctaaaa

SEQ ID NO: 740030 - DNA, 13 bp, C. elegans
tttcaacctattt

SEQ ID NO: 740031 - DNA, 13 bp, C. elegans
tttcaacgatttc

SEQ ID NO: 740032 - DNA, 13 bp, C. elegans
tttcaacgatttt

SEQ ID NO: 740033 - DNA, 13 bp, C. elegans
tttcaacgtatta

SEQ ID NO: 740034 - DNA, 13 bp, C. elegans
tttcaacgttttt

SEQ ID NO: 740035 - DNA, 13 bp, C. elegans
tttcaactaataa

SEQ ID NO: 740036 - DNA, 13 bp, C. elegans
tttcaactaattt

SEQ ID NO: 740037 - DNA, 13 bp, C. elegans
tttcaactacaaa

SEQ ID NO: 740038 - DNA, 13 bp, C. elegans
tttcaactagatt

SEQ ID NO: 740039 - DNA, 13 bp, C. elegans
tttcaactattca

SEQ ID NO: 740040 - DNA, 13 bp, C. elegans
tttcaactcaact

SEQ ID NO: 740041 - DNA, 13 bp, C. elegans
tttcaactcgatt

SEQ ID NO: 740042 - DNA, 13 bp, C. elegans
tttcaactgaaaa

SEQ ID NO: 740043 - DNA, 13 bp, C. elegans
tttcaactgaatt

SEQ ID NO: 740044 - DNA, 13 bp, C. elegans
tttcaactgattt

SEQ ID NO: 740045 - DNA, 13 bp, C. elegans
tttcaactgcaaa

SEQ ID NO: 740046 - DNA, 14 bp, C. elegans
tttcaactggaaaa

SEQ ID NO: 740047 - DNA, 13 bp, C. elegans
tttcaacttaaaa

SEQ ID NO: 740048 - DNA, 13 bp, C. elegans
tttcaacttattc

SEQ ID NO: 740049 - DNA, 13 bp, C. elegans
tttcaacttcaaa

SEQ ID NO: 740050 - DNA, 13 bp, C. elegans
tttcaacttcaat

SEQ ID NO: 740051 - DNA, 13 bp, C. elegans
tttcaacttggaa

SEQ ID NO: 740052 - DNA, 14 bp, C. elegans
tttcaacttgtttt

SEQ ID NO: 740053 - DNA, 13 bp, C. elegans
tttcaactttaca

SEQ ID NO: 740054 - DNA, 13 bp, C. elegans
tttcaactttcaa

SEQ ID NO: 740055 - DNA, 13 bp, C. elegans
tttcaactttcat

SEQ ID NO: 740056 - DNA, 13 bp, C. elegans
tttcaactttcct

SEQ ID NO: 740057 - DNA, 13 bp, C. elegans
tttcaactttgca

SEQ ID NO: 740058 - DNA, 13 bp, C. elegans
tttcaacttttag

SEQ ID NO: 740059 - DNA, 13 bp, C. elegans
tttcaacttttca

SEQ ID NO: 740060 - DNA, 13 bp, C. elegans
tttcaacttttcg

SEQ ID NO: 740061 - DNA, 13 bp, C. elegans
tttcaactttttg

SEQ ID NO: 740062 - DNA, 13 bp, C. elegans
tttcaagaaaaat

SEQ ID NO: 740063 - DNA, 13 bp, C. elegans
tttcaagaaaata

SEQ ID NO: 740064 - DNA, 13 bp, C. elegans
tttcaagaaaatt

SEQ ID NO: 740065 - DNA, 13 bp, C. elegans
tttcaagaaatat

SEQ ID NO: 740066 - DNA, 13 bp, C. elegans
tttcaagaaatgg

SEQ ID NO: 740067 - DNA, 13 bp, C. elegans
tttcaagaaatta

SEQ ID NO: 740068 - DNA, 13 bp, C. elegans
tttcaagaaattg

SEQ ID NO: 740069 - DNA, 13 bp, C. elegans
tttcaagaaattt

SEQ ID NO: 740070 - DNA, 13 bp, C. elegans
tttcaagaacatt

SEQ ID NO: 740071 - DNA, 13 bp, C. elegans
tttcaagaagaac

SEQ ID NO: 740072 - DNA, 13 bp, C. elegans
tttcaagaagctt

SEQ ID NO: 740073 - DNA, 13 bp, C. elegans
tttcaagaagttt

SEQ ID NO: 740074 - DNA, 13 bp, C. elegans
tttcaagaattta

SEQ ID NO: 740075 - DNA, 13 bp, C. elegans
tttcaagaatttt

SEQ ID NO: 740076 - DNA, 13 bp, C. elegans
tttcaagacattt

SEQ ID NO: 740077 - DNA, 13 bp, C. elegans
tttcaagagattt

SEQ ID NO: 740078 - DNA, 13 bp, C. elegans
tttcaagagtatt

SEQ ID NO: 740079 - DNA, 13 bp, C. elegans
tttcaagataaat

SEQ ID NO: 740080 - DNA, 13 bp, C. elegans
tttcaagattgtt

SEQ ID NO: 740081 - DNA, 13 bp, C. elegans
tttcaagatttca

SEQ ID NO: 740082 - DNA, 13 bp, C. elegans
tttcaagcaaaaa

SEQ ID NO: 740083 - DNA, 13 bp, C. elegans
tttcaagcaattt

SEQ ID NO: 740084 - DNA, 13 bp, C. elegans
tttcaagcacaaa

SEQ ID NO: 740085 - DNA, 13 bp, C. elegans
tttcaagcatttt

SEQ ID NO: 740086 - DNA, 13 bp, C. elegans
tttcaagccaaaa

SEQ ID NO: 740087 - DNA, 13 bp, C. elegans
tttcaagccaatt

SEQ ID NO: 740088 - DNA, 13 bp, C. elegans
tttcaagcgaaaa

SEQ ID NO: 740089 - DNA, 13 bp, C. elegans
tttcaagctaatt

SEQ ID NO: 740090 - DNA, 13 bp, C. elegans
tttcaagctcaaa

SEQ ID NO: 740091 - DNA, 13 bp, C. elegans
tttcaagctgaaa

SEQ ID NO: 740092 - DNA, 13 bp, C. elegans
tttcaagctttca

SEQ ID NO: 740093 - DNA, 13 bp, C. elegans
tttcaaggatttt

SEQ ID NO: 740094 - DNA, 13 bp, C. elegans
tttcaaggctttt

SEQ ID NO: 740095 - DNA, 13 bp, C. elegans
tttcaagtaaaaa

SEQ ID NO: 740096 - DNA, 13 bp, C. elegans
tttcaagtaataa

SEQ ID NO: 740097 - DNA, 13 bp, C. elegans
tttcaagtaattt

SEQ ID NO: 740098 - DNA, 13 bp, C. elegans
tttcaagtacatt

SEQ ID NO: 740099 - DNA, 13 bp, C. elegans
tttcaagtattaa

SEQ ID NO: 740100 - DNA, 13 bp, C. elegans
tttcaagtcaaat

SEQ ID NO: 740101 - DNA, 13 bp, C. elegans
tttcaagtgaaaa

SEQ ID NO: 740102 - DNA, 13 bp, C. elegans
tttcaagtggaaa

SEQ ID NO: 740103 - DNA, 13 bp, C. elegans
tttcaagtgtgct

SEQ ID NO: 740104 - DNA, 13 bp, C. elegans
tttcaagttattt

SEQ ID NO: 740105 - DNA, 13 bp, C. elegans
tttcaagttcaat

SEQ ID NO: 740106 - DNA, 13 bp, C. elegans
tttcaagttcata

SEQ ID NO: 740107 - DNA, 13 bp, C. elegans
tttcaagttgaaa

SEQ ID NO: 740108 - DNA, 13 bp, C. elegans
tttcaagtttata

SEQ ID NO: 740109 - DNA, 13 bp, C. elegans
tttcaagtttcaa

SEQ ID NO: 740110 - DNA, 13 bp, C. elegans
tttcaagtttctg

SEQ ID NO: 740111 - DNA, 13 bp, C. elegans
tttcaagttttat

SEQ ID NO: 740112 - DNA, 13 bp, C. elegans
tttcaagttttca

SEQ ID NO: 740113 - DNA, 13 bp, C. elegans
tttcaagttttcc

SEQ ID NO: 740114 - DNA, 13 bp, C. elegans
tttcaagttttct

SEQ ID NO: 740115 - DNA, 13 bp, C. elegans
tttcaagtttttc

SEQ ID NO: 740116 - DNA, 13 bp, C. elegans
tttcaataaaatc

SEQ ID NO: 740117 - DNA, 13 bp, C. elegans
tttcaataaacaa

SEQ ID NO: 740118 - DNA, 13 bp, C. elegans
tttcaataaatgt

SEQ ID NO: 740119 - DNA, 13 bp, C. elegans
tttcaataagaaa

SEQ ID NO: 740120 - DNA, 13 bp, C. elegans
tttcaataatgaa

SEQ ID NO: 740121 - DNA, 13 bp, C. elegans
tttcaataatgtt

SEQ ID NO: 740122 - DNA, 13 bp, C. elegans
tttcaataatttc

SEQ ID NO: 740123 - DNA, 13 bp, C. elegans
tttcaataatttg

SEQ ID NO: 740124 - DNA, 13 bp, C. elegans
tttcaatacattt

SEQ ID NO: 740125 - DNA, 13 bp, C. elegans
tttcaatagaaaa

SEQ ID NO: 740126 - DNA, 13 bp, C. elegans
tttcaatagaaat

SEQ ID NO: 740127 - DNA, 13 bp, C. elegans
tttcaatagtttt

SEQ ID NO: 740128 - DNA, 13 bp, C. elegans
tttcaatatagaa

SEQ ID NO: 740129 - DNA, 13 bp, C. elegans
tttcaatatgata

SEQ ID NO: 740130 - DNA, 13 bp, C. elegans
tttcaatatgcaa

SEQ ID NO: 740131 - DNA, 13 bp, C. elegans
tttcaatatgttc

SEQ ID NO: 740132 - DNA, 13 bp, C. elegans
tttcaatatgttt

SEQ ID NO: 740133 - DNA, 13 bp, C. elegans
tttcaatattaca

SEQ ID NO: 740134 - DNA, 13 bp, C. elegans
tttcaatattcag

SEQ ID NO: 740135 - DNA, 13 bp, C. elegans
tttcaatattcat

SEQ ID NO: 740136 - DNA, 13 bp, C. elegans
tttcaatattcca

SEQ ID NO: 740137 - DNA, 13 bp, C. elegans
tttcaatattctc

SEQ ID NO: 740138 - DNA, 13 bp, C. elegans
tttcaatattgaa

SEQ ID NO: 740139 - DNA, 13 bp, C. elegans
tttcaatattgca

SEQ ID NO: 740140 - DNA, 13 bp, C. elegans
tttcaatattgtt

SEQ ID NO: 740141 - DNA, 13 bp, C. elegans
tttcaatatttca

SEQ ID NO: 740142 - DNA, 13 bp, C. elegans
tttcaatatttga

SEQ ID NO: 740143 - DNA, 13 bp, C. elegans
tttcaatatttgc

SEQ ID NO: 740144 - DNA, 13 bp, C. elegans
tttcaatattttg

SEQ ID NO: 740145 - DNA, 13 bp, C. elegans
tttcaatcaaaaa

SEQ ID NO: 740146 - DNA, 13 bp, C. elegans
tttcaatcaaaac

SEQ ID NO: 740147 - DNA, 13 bp, C. elegans
tttcaatcaagaa

SEQ ID NO: 740148 - DNA, 13 bp, C. elegans
tttcaatcaagtt

SEQ ID NO: 740149 - DNA, 13 bp, C. elegans
tttcaatcagaaa

SEQ ID NO: 740150 - DNA, 13 bp, C. elegans
tttcaatcagaat

SEQ ID NO: 740151 - DNA, 13 bp, C. elegans
tttcaatcagttt

SEQ ID NO: 740152 - DNA, 13 bp, C. elegans
tttcaatcataaa

SEQ ID NO: 740153 - DNA, 13 bp, C. elegans
tttcaatcatttc

SEQ ID NO: 740154 - DNA, 13 bp, C. elegans
tttcaatccaaga

SEQ ID NO: 740155 - DNA, 13 bp, C. elegans
tttcaatcgaaaa

SEQ ID NO: 740156 - DNA, 13 bp, C. elegans
tttcaatcgatta

SEQ ID NO: 740157 - DNA, 13 bp, C. elegans
tttcaatcgattt

SEQ ID NO: 740158 - DNA, 13 bp, C. elegans
tttcaatcggaaa

SEQ ID NO: 740159 - DNA, 13 bp, C. elegans
tttcaatctaaat

SEQ ID NO: 740160 - DNA, 13 bp, C. elegans
tttcaatctgaaa

SEQ ID NO: 740161 - DNA, 13 bp, C. elegans
tttcaatgaaaac

SEQ ID NO: 740162 - DNA, 13 bp, C. elegans
tttcaatgaaaat

SEQ ID NO: 740163 - DNA, 13 bp, C. elegans
tttcaatgaaaca

SEQ ID NO: 740164 - DNA, 13 bp, C. elegans
tttcaatgaaatg

SEQ ID NO: 740165 - DNA, 13 bp, C. elegans
tttcaatgaatct

SEQ ID NO: 740166 - DNA, 13 bp, C. elegans
tttcaatgaattc

SEQ ID NO: 740167 - DNA, 13 bp, C. elegans
tttcaatgacttt

SEQ ID NO: 740168 - DNA, 13 bp, C. elegans
tttcaatgagaaa

SEQ ID NO: 740169 - DNA, 13 bp, C. elegans
tttcaatgatgaa

SEQ ID NO: 740170 - DNA, 13 bp, C. elegans
tttcaatgatttt

SEQ ID NO: 740171 - DNA, 13 bp, C. elegans
tttcaatgcaaaa

SEQ ID NO: 740172 - DNA, 13 bp, C. elegans
tttcaatgcaaat

SEQ ID NO: 740173 - DNA, 13 bp, C. elegans
tttcaatgctaaa

SEQ ID NO: 740174 - DNA, 13 bp, C. elegans
tttcaatgctttt

SEQ ID NO: 740175 - DNA, 13 bp, C. elegans
tttcaatggaaaa

SEQ ID NO: 740176 - DNA, 13 bp, C. elegans
tttcaatggaaat

SEQ ID NO: 740177 - DNA, 13 bp, C. elegans
tttcaatggattt

SEQ ID NO: 740178 - DNA, 13 bp, C. elegans
tttcaatgtaaaa

SEQ ID NO: 740179 - DNA, 13 bp, C. elegans
tttcaatgtattt

SEQ ID NO: 740180 - DNA, 13 bp, C. elegans
tttcaatgtgaaa

SEQ ID NO: 740181 - DNA, 13 bp, C. elegans
tttcaatgtgttt

SEQ ID NO: 740182 - DNA, 14 bp, C. elegans
tttcaatgttcaaa

SEQ ID NO: 740183 - DNA, 13 bp, C. elegans
tttcaatgttcca

SEQ ID NO: 740184 - DNA, 13 bp, C. elegans
tttcaatgttgaa

SEQ ID NO: 740185 - DNA, 13 bp, C. elegans
tttcaattacaat

SEQ ID NO: 740186 - DNA, 13 bp, C. elegans
tttcaattagttt

SEQ ID NO: 740187 - DNA, 13 bp, C. elegans
tttcaattatgat

SEQ ID NO: 740188 - DNA, 13 bp, C. elegans
tttcaattattag

SEQ ID NO: 740189 - DNA, 13 bp, C. elegans
tttcaattatttg

SEQ ID NO: 740190 - DNA, 13 bp, C. elegans
tttcaattcaact

SEQ ID NO: 740191 - DNA, 13 bp, C. elegans
tttcaattcaata

SEQ ID NO: 740192 - DNA, 13 bp, C. elegans
tttcaattcaatt

SEQ ID NO: 740193 - DNA, 13 bp, C. elegans
tttcaattcatat

SEQ ID NO: 740194 - DNA, 13 bp, C. elegans
tttcaattccagc

SEQ ID NO: 740195 - DNA, 13 bp, C. elegans
tttcaattccgaa

SEQ ID NO: 740196 - DNA, 13 bp, C. elegans
tttcaattccggt

SEQ ID NO: 740197 - DNA, 13 bp, C. elegans
tttcaattctcaa

SEQ ID NO: 740198 - DNA, 13 bp, C. elegans
tttcaattctcca

SEQ ID NO: 740199 - DNA, 13 bp, C. elegans
tttcaattcttcc

SEQ ID NO: 740200 - DNA, 13 bp, C. elegans
tttcaattcttgc

SEQ ID NO: 740201 - DNA, 13 bp, C. elegans
tttcaattcttgt

SEQ ID NO: 740202 - DNA, 13 bp, C. elegans
tttcaattgaaaa

SEQ ID NO: 740203 - DNA, 13 bp, C. elegans
tttcaattgaaca

SEQ ID NO: 740204 - DNA, 13 bp, C. elegans
tttcaattgaatt

SEQ ID NO: 740205 - DNA, 13 bp, C. elegans
tttcaattgattt

SEQ ID NO: 740206 - DNA, 13 bp, C. elegans
tttcaattgcatt

SEQ ID NO: 740207 - DNA, 13 bp, C. elegans
tttcaattggaaa

SEQ ID NO: 740208 - DNA, 13 bp, C. elegans
tttcaattggttt

SEQ ID NO: 740209 - DNA, 13 bp, C. elegans
tttcaattgtgat

SEQ ID NO: 740210 - DNA, 13 bp, C. elegans
tttcaattgtgca

SEQ ID NO: 740211 - DNA, 13 bp, C. elegans
tttcaattgtgtt

SEQ ID NO: 740212 - DNA, 13 bp, C. elegans
tttcaattgttcg

SEQ ID NO: 740213 - DNA, 13 bp, C. elegans
tttcaattgtttg

SEQ ID NO: 740214 - DNA, 13 bp, C. elegans
tttcaatttatca

SEQ ID NO: 740215 - DNA, 13 bp, C. elegans
tttcaatttatcg

SEQ ID NO: 740216 - DNA, 13 bp, C. elegans
tttcaatttatga

SEQ ID NO: 740217 - DNA, 13 bp, C. elegans
tttcaatttcaac

SEQ ID NO: 740218 - DNA, 13 bp, C. elegans
tttcaatttcaat

SEQ ID NO: 740219 - DNA, 13 bp, C. elegans
tttcaatttcact

SEQ ID NO: 740220 - DNA, 13 bp, C. elegans
tttcaatttcagg

SEQ ID NO: 740221 - DNA, 13 bp, C. elegans
tttcaatttccaa

SEQ ID NO: 740222 - DNA, 13 bp, C. elegans
tttcaatttcgaa

SEQ ID NO: 740223 - DNA, 13 bp, C. elegans
tttcaatttctaa

SEQ ID NO: 740224 - DNA, 13 bp, C. elegans
tttcaatttctag

SEQ ID NO: 740225 - DNA, 13 bp, C. elegans
tttcaatttgata

SEQ ID NO: 740226 - DNA, 13 bp, C. elegans
tttcaatttgcaa

SEQ ID NO: 740227 - DNA, 13 bp, C. elegans
tttcaatttgcat

SEQ ID NO: 740228 - DNA, 13 bp, C. elegans
tttcaatttgtcg

SEQ ID NO: 740229 - DNA, 14 bp, C. elegans
tttcaatttgttca

SEQ ID NO: 740230 - DNA, 13 bp, C. elegans
tttcaattttaac

SEQ ID NO: 740231 - DNA, 13 bp, C. elegans
tttcaattttaag

SEQ ID NO: 740232 - DNA, 13 bp, C. elegans
tttcaattttaca

SEQ ID NO: 740233 - DNA, 13 bp, C. elegans
tttcaattttatg

SEQ ID NO: 740234 - DNA, 13 bp, C. elegans
tttcaattttcac

SEQ ID NO: 740235 - DNA, 13 bp, C. elegans
tttcaattttccc

SEQ ID NO: 740236 - DNA, 13 bp, C. elegans
tttcaattttccg

SEQ ID NO: 740237 - DNA, 13 bp, C. elegans
tttcaattttcgg

SEQ ID NO: 740238 - DNA, 13 bp, C. elegans
tttcaattttcgt

SEQ ID NO: 740239 - DNA, 13 bp, C. elegans
tttcaattttgaa

SEQ ID NO: 740240 - DNA, 13 bp, C. elegans
tttcaattttgac

SEQ ID NO: 740241 - DNA, 13 bp, C. elegans
tttcaattttgat

SEQ ID NO: 740242 - DNA, 13 bp, C. elegans
tttcaattttgtc

SEQ ID NO: 740243 - DNA, 13 bp, C. elegans
tttcacaaaaaat

SEQ ID NO: 740244 - DNA, 13 bp, C. elegans
tttcacaaaaacg

SEQ ID NO: 740245 - DNA, 13 bp, C. elegans
tttcacaaaaact

SEQ ID NO: 740246 - DNA, 13 bp, C. elegans
tttcacaaaatta

SEQ ID NO: 740247 - DNA, 13 bp, C. elegans
tttcacaaaattt

SEQ ID NO: 740248 - DNA, 13 bp, C. elegans
tttcacaaataat

SEQ ID NO: 740249 - DNA, 13 bp, C. elegans
tttcacaaatatt

SEQ ID NO: 740250 - DNA, 13 bp, C. elegans
tttcacaaatgtt

SEQ ID NO: 740251 - DNA, 13 bp, C. elegans
tttcacaaatttg

SEQ ID NO: 740252 - DNA, 13 bp, C. elegans
tttcacaaatttt

SEQ ID NO: 740253 - DNA, 13 bp, C. elegans
tttcacaacaaat

SEQ ID NO: 740254 - DNA, 13 bp, C. elegans
tttcacaactttt

SEQ ID NO: 740255 - DNA, 13 bp, C. elegans
tttcacaagaaaa

SEQ ID NO: 740256 - DNA, 13 bp, C. elegans
tttcacaagattt

SEQ ID NO: 740257 - DNA, 13 bp, C. elegans
tttcacaagtttc

SEQ ID NO: 740258 - DNA, 13 bp, C. elegans
tttcacaagtttt

SEQ ID NO: 740259 - DNA, 13 bp, C. elegans
tttcacaattaat

SEQ ID NO: 740260 - DNA, 13 bp, C. elegans
tttcacaattatt

SEQ ID NO: 740261 - DNA, 13 bp, C. elegans
tttcacaattctt

SEQ ID NO: 740262 - DNA, 13 bp, C. elegans
tttcacaatttca

SEQ ID NO: 740263 - DNA, 13 bp, C. elegans
tttcacaatttga

SEQ ID NO: 740264 - DNA, 13 bp, C. elegans
tttcacaattttc

SEQ ID NO: 740265 - DNA, 13 bp, C. elegans
tttcacacaattt

SEQ ID NO: 740266 - DNA, 13 bp, C. elegans
tttcacacatttt

SEQ ID NO: 740267 - DNA, 13 bp, C. elegans
tttcacacctttt

SEQ ID NO: 740268 - DNA, 13 bp, C. elegans
tttcacactaaaa

SEQ ID NO: 740269 - DNA, 13 bp, C. elegans
tttcacactattt

SEQ ID NO: 740270 - DNA, 13 bp, C. elegans
tttcacactgaaa

SEQ ID NO: 740271 - DNA, 13 bp, C. elegans
tttcacagaaatc

SEQ ID NO: 740272 - DNA, 13 bp, C. elegans
tttcacagatttt

SEQ ID NO: 740273 - DNA, 13 bp, C. elegans
tttcacagcaaaa

SEQ ID NO: 740274 - DNA, 13 bp, C. elegans
tttcacagccttt

SEQ ID NO: 740275 - DNA, 13 bp, C. elegans
tttcacagttaat

SEQ ID NO: 740276 - DNA, 13 bp, C. elegans
tttcacagttttt

SEQ ID NO: 740277 - DNA, 13 bp, C. elegans
tttcacatcaaaa

SEQ ID NO: 740278 - DNA, 13 bp, C. elegans
tttcacatcaaat

SEQ ID NO: 740279 - DNA, 13 bp, C. elegans
tttcacatcattt

SEQ ID NO: 740280 - DNA, 13 bp, C. elegans
tttcacatgtttt

SEQ ID NO: 740281 - DNA, 13 bp, C. elegans
tttcacattaaaa

SEQ ID NO: 740282 - DNA, 13 bp, C. elegans
tttcacattcatc

SEQ ID NO: 740283 - DNA, 13 bp, C. elegans
tttcacattctca

SEQ ID NO: 740284 - DNA, 13 bp, C. elegans
tttcacatttaca

SEQ ID NO: 740285 - DNA, 13 bp, C. elegans
tttcacatttgaa

SEQ ID NO: 740286 - DNA, 13 bp, C. elegans
tttcacattttaa

SEQ ID NO: 740287 - DNA, 13 bp, C. elegans
tttcacattttca

SEQ ID NO: 740288 - DNA, 13 bp, C. elegans
tttcacattttcc

SEQ ID NO: 740289 - DNA, 13 bp, C. elegans
tttcacattttga

SEQ ID NO: 740290 - DNA, 13 bp, C. elegans
tttcacattttgt

SEQ ID NO: 740291 - DNA, 13 bp, C. elegans
tttcacatttttg

SEQ ID NO: 740292 - DNA, 13 bp, C. elegans
tttcaccaaaaaa

SEQ ID NO: 740293 - DNA, 13 bp, C. elegans
tttcaccaaaatc

SEQ ID NO: 740294 - DNA, 13 bp, C. elegans
tttcaccaaattt

SEQ ID NO: 740295 - DNA, 13 bp, C. elegans
tttcaccaatttt

SEQ ID NO: 740296 - DNA, 13 bp, C. elegans
tttcaccaccttc

SEQ ID NO: 740297 - DNA, 13 bp, C. elegans
tttcaccactttt

SEQ ID NO: 740298 - DNA, 13 bp, C. elegans
tttcaccagttta

SEQ ID NO: 740299 - DNA, 13 bp, C. elegans
tttcaccagtttt

SEQ ID NO: 740300 - DNA, 13 bp, C. elegans
tttcacccaaaaa

SEQ ID NO: 740301 - DNA, 13 bp, C. elegans
tttcacccaaatt

SEQ ID NO: 740302 - DNA, 13 bp, C. elegans
tttcacccaactc

SEQ ID NO: 740303 - DNA, 13 bp, C. elegans
tttcacccatttc

SEQ ID NO: 740304 - DNA, 13 bp, C. elegans
tttcaccgaaaaa

SEQ ID NO: 740305 - DNA, 13 bp, C. elegans
tttcaccgaaaat

SEQ ID NO: 740306 - DNA, 13 bp, C. elegans
tttcaccgaaatt

SEQ ID NO: 740307 - DNA, 13 bp, C. elegans
tttcaccgatttt

SEQ ID NO: 740308 - DNA, 13 bp, C. elegans
tttcaccggaaaa

SEQ ID NO: 740309 - DNA, 13 bp, C. elegans
tttcaccggaaat

SEQ ID NO: 740310 - DNA, 13 bp, C. elegans
tttcaccggtttt

SEQ ID NO: 740311 - DNA, 13 bp, C. elegans
tttcacctagaaa

SEQ ID NO: 740312 - DNA, 13 bp, C. elegans
tttcacctgaaaa

SEQ ID NO: 740313 - DNA, 13 bp, C. elegans
tttcacctgtttt

SEQ ID NO: 740314 - DNA, 13 bp, C. elegans
tttcacgagaaat

SEQ ID NO: 740315 - DNA, 13 bp, C. elegans
tttcacgatttca

SEQ ID NO: 740316 - DNA, 13 bp, C. elegans
tttcacgattttc

SEQ ID NO: 740317 - DNA, 13 bp, C. elegans
tttcacgattttt

SEQ ID NO: 740318 - DNA, 13 bp, C. elegans
tttcacgcaattt

SEQ ID NO: 740319 - DNA, 13 bp, C. elegans
tttcacgccaaaa

SEQ ID NO: 740320 - DNA, 13 bp, C. elegans
tttcacgccaagc

SEQ ID NO: 740321 - DNA, 13 bp, C. elegans
tttcacggatttt

SEQ ID NO: 740322 - DNA, 13 bp, C. elegans
tttcacgggtttt

SEQ ID NO: 740323 - DNA, 13 bp, C. elegans
tttcacggttttt

SEQ ID NO: 740324 - DNA, 13 bp, C. elegans
tttcacgtatttt

SEQ ID NO: 740325 - DNA, 13 bp, C. elegans
tttcacgtcattt

SEQ ID NO: 740326 - DNA, 13 bp, C. elegans
tttcacgtgtttt

SEQ ID NO: 740327 - DNA, 13 bp, C. elegans
tttcacgttaaaa

SEQ ID NO: 740328 - DNA, 13 bp, C. elegans
tttcacgttgaaa

SEQ ID NO: 740329 - DNA, 13 bp, C. elegans
tttcacgttttca

SEQ ID NO: 740330 - DNA, 13 bp, C. elegans
tttcacgttttga

SEQ ID NO: 740331 - DNA, 13 bp, C. elegans
tttcacgtttttc

SEQ ID NO: 740332 - DNA, 13 bp, C. elegans
tttcactaaaagt

SEQ ID NO: 740333 - DNA, 13 bp, C. elegans
tttcactaaaatt

SEQ ID NO: 740334 - DNA, 13 bp, C. elegans
tttcactaaattt

SEQ ID NO: 740335 - DNA, 13 bp, C. elegans
tttcactcaaaaa

SEQ ID NO: 740336 - DNA, 13 bp, C. elegans
tttcactcaattt

SEQ ID NO: 740337 - DNA, 13 bp, C. elegans
tttcactcacttt

SEQ ID NO: 740338 - DNA, 13 bp, C. elegans
tttcactccaaaa

SEQ ID NO: 740339 - DNA, 13 bp, C. elegans
tttcactcgaaaa

SEQ ID NO: 740340 - DNA, 13 bp, C. elegans
tttcactcgtttt

SEQ ID NO: 740341 - DNA, 13 bp, C. elegans
tttcactctttca

SEQ ID NO: 740342 - DNA, 13 bp, C. elegans
tttcactgaaaaa

SEQ ID NO: 740343 - DNA, 13 bp, C. elegans
tttcactgaaaat

SEQ ID NO: 740344 - DNA, 13 bp, C. elegans
tttcactgcaact

SEQ ID NO: 740345 - DNA, 13 bp, C. elegans
tttcactgctact

SEQ ID NO: 740346 - DNA, 13 bp, C. elegans
tttcactgctttt

SEQ ID NO: 740347 - DNA, 13 bp, C. elegans
tttcactggaaaa

SEQ ID NO: 740348 - DNA, 13 bp, C. elegans
tttcactggtttt

SEQ ID NO: 740349 - DNA, 13 bp, C. elegans
tttcactgtaaaa

SEQ ID NO: 740350 - DNA, 13 bp, C. elegans
tttcactgtattt

SEQ ID NO: 740351 - DNA, 13 bp, C. elegans
tttcactgtgaaa

SEQ ID NO: 740352 - DNA, 13 bp, C. elegans
tttcactgttaaa

SEQ ID NO: 740353 - DNA, 13 bp, C. elegans
tttcactgttatt

SEQ ID NO: 740354 - DNA, 13 bp, C. elegans
tttcactgtttaa

SEQ ID NO: 740355 - DNA, 13 bp, C. elegans
tttcactgtttca

SEQ ID NO: 740356 - DNA, 13 bp, C. elegans
tttcactgtttta

SEQ ID NO: 740357 - DNA, 13 bp, C. elegans
tttcacttaaaat

SEQ ID NO: 740358 - DNA, 13 bp, C. elegans
tttcacttcaaaa

SEQ ID NO: 740359 - DNA, 13 bp, C. elegans
tttcacttcaatt

SEQ ID NO: 740360 - DNA, 13 bp, C. elegans
tttcacttctaaa

SEQ ID NO: 740361 - DNA, 13 bp, C. elegans
tttcacttgaaac

SEQ ID NO: 740362 - DNA, 13 bp, C. elegans
tttcacttggaaa

SEQ ID NO: 740363 - DNA, 13 bp, C. elegans
tttcactttcaaa

SEQ ID NO: 740364 - DNA, 13 bp, C. elegans
tttcactttcaca

SEQ ID NO: 740365 - DNA, 13 bp, C. elegans
tttcactttgaca

SEQ ID NO: 740366 - DNA, 13 bp, C. elegans
tttcacttttcca

SEQ ID NO: 740367 - DNA, 13 bp, C. elegans
tttcacttttgca

SEQ ID NO: 740368 - DNA, 13 bp, C. elegans
tttcacttttgct

SEQ ID NO: 740369 - DNA, 13 bp, C. elegans
tttcactttttga

SEQ ID NO: 740370 - DNA, 13 bp, C. elegans
tttcagaaaaaaa

SEQ ID NO: 740371 - DNA, 13 bp, C. elegans
tttcagaaaaatt

SEQ ID NO: 740372 - DNA, 13 bp, C. elegans
tttcagaaaacag

SEQ ID NO: 740373 - DNA, 13 bp, C. elegans
tttcagaaaacca

SEQ ID NO: 740374 - DNA, 13 bp, C. elegans
tttcagaaaacta

SEQ ID NO: 740375 - DNA, 13 bp, C. elegans
tttcagaaaagtt

SEQ ID NO: 740376 - DNA, 13 bp, C. elegans
tttcagaaaataa

SEQ ID NO: 740377 - DNA, 13 bp, C. elegans
tttcagaaaatga

SEQ ID NO: 740378 - DNA, 13 bp, C. elegans
tttcagaaacaaa

SEQ ID NO: 740379 - DNA, 13 bp, C. elegans
tttcagaaacatt

SEQ ID NO: 740380 - DNA, 13 bp, C. elegans
tttcagaaacttt

SEQ ID NO: 740381 - DNA, 13 bp, C. elegans
tttcagaaagaaa

SEQ ID NO: 740382 - DNA, 13 bp, C. elegans
tttcagaaagatt

SEQ ID NO: 740383 - DNA, 13 bp, C. elegans
tttcagaaaggtt

SEQ ID NO: 740384 - DNA, 13 bp, C. elegans
tttcagaaatgca

SEQ ID NO: 740385 - DNA, 13 bp, C. elegans
tttcagaaattct

SEQ ID NO: 740386 - DNA, 13 bp, C. elegans
tttcagaaatttt

SEQ ID NO: 740387 - DNA, 13 bp, C. elegans
tttcagaacaaag

SEQ ID NO: 740388 - DNA, 13 bp, C. elegans
tttcagaacatgc

SEQ ID NO: 740389 - DNA, 13 bp, C. elegans
tttcagaacattt

SEQ ID NO: 740390 - DNA, 13 bp, C. elegans
tttcagaaccaaa

SEQ ID NO: 740391 - DNA, 13 bp, C. elegans
tttcagaacttca

SEQ ID NO: 740392 - DNA, 13 bp, C. elegans
tttcagaagattt

SEQ ID NO: 740393 - DNA, 13 bp, C. elegans
tttcagaagtttc

SEQ ID NO: 740394 - DNA, 13 bp, C. elegans
tttcagaataaaa

SEQ ID NO: 740395 - DNA, 13 bp, C. elegans
tttcagaatgaaa

SEQ ID NO: 740396 - DNA, 13 bp, C. elegans
tttcagaatgaat

SEQ ID NO: 740397 - DNA, 13 bp, C. elegans
tttcagaattctt

SEQ ID NO: 740398 - DNA, 13 bp, C. elegans
tttcagaattgtt

SEQ ID NO: 740399 - DNA, 13 bp, C. elegans
tttcagaatttca

SEQ ID NO: 740400 - DNA, 13 bp, C. elegans
tttcagaatttga

SEQ ID NO: 740401 - DNA, 13 bp, C. elegans
tttcagaattttg

SEQ ID NO: 740402 - DNA, 13 bp, C. elegans
tttcagaattttt

SEQ ID NO: 740403 - DNA, 13 bp, C. elegans
tttcagacaaatt

SEQ ID NO: 740404 - DNA, 13 bp, C. elegans
tttcagacaattt

SEQ ID NO: 740405 - DNA, 13 bp, C. elegans
tttcagacagaaa

SEQ ID NO: 740406 - DNA, 13 bp, C. elegans
tttcagactttct

SEQ ID NO: 740407 - DNA, 13 bp, C. elegans
tttcagagaaaat

SEQ ID NO: 740408 - DNA, 13 bp, C. elegans
tttcagagaacaa

SEQ ID NO: 740409 - DNA, 13 bp, C. elegans
tttcagagaattg

SEQ ID NO: 740410 - DNA, 13 bp, C. elegans
tttcagagcaatt

SEQ ID NO: 740411 - DNA, 13 bp, C. elegans
tttcagagtattt

SEQ ID NO: 740412 - DNA, 13 bp, C. elegans
tttcagagttttc

SEQ ID NO: 740413 - DNA, 13 bp, C. elegans
tttcagagttttt

SEQ ID NO: 740414 - DNA, 13 bp, C. elegans
tttcagataaaaa

SEQ ID NO: 740415 - DNA, 13 bp, C. elegans
tttcagatatatt

SEQ ID NO: 740416 - DNA, 13 bp, C. elegans
tttcagatattcc

SEQ ID NO: 740417 - DNA, 13 bp, C. elegans
tttcagatatttg

SEQ ID NO: 740418 - DNA, 13 bp, C. elegans
tttcagatatttt

SEQ ID NO: 740419 - DNA, 13 bp, C. elegans
tttcagatcaaaa

SEQ ID NO: 740420 - DNA, 13 bp, C. elegans
tttcagatctttt

SEQ ID NO: 740421 - DNA, 13 bp, C. elegans
tttcagatgtttt

SEQ ID NO: 740422 - DNA, 13 bp, C. elegans
tttcagattaaaa

SEQ ID NO: 740423 - DNA, 13 bp, C. elegans
tttcagattaata

SEQ ID NO: 740424 - DNA, 13 bp, C. elegans
tttcagattaatc

SEQ ID NO: 740425 - DNA, 13 bp, C. elegans
tttcagattattc

SEQ ID NO: 740426 - DNA, 13 bp, C. elegans
tttcagattgaaa

SEQ ID NO: 740427 - DNA, 13 bp, C. elegans
tttcagatttaaa

SEQ ID NO: 740428 - DNA, 13 bp, C. elegans
tttcagatttatg

SEQ ID NO: 740429 - DNA, 13 bp, C. elegans
tttcagatttcct

SEQ ID NO: 740430 - DNA, 13 bp, C. elegans
tttcagattttaa

SEQ ID NO: 740431 - DNA, 13 bp, C. elegans
tttcagattttga

SEQ ID NO: 740432 - DNA, 13 bp, C. elegans
tttcagatttttg

SEQ ID NO: 740433 - DNA, 13 bp, C. elegans
tttcagcaaaaaa

SEQ ID NO: 740434 - DNA, 13 bp, C. elegans
tttcagcaaaaac

SEQ ID NO: 740435 - DNA, 13 bp, C. elegans
tttcagcaaaact

SEQ ID NO: 740436 - DNA, 13 bp, C. elegans
tttcagcaaactt

SEQ ID NO: 740437 - DNA, 13 bp, C. elegans
tttcagcaaattt

SEQ ID NO: 740438 - DNA, 13 bp, C. elegans
tttcagcaagttt

SEQ ID NO: 740439 - DNA, 13 bp, C. elegans
tttcagcaattgc

SEQ ID NO: 740440 - DNA, 13 bp, C. elegans
tttcagcaatttt

SEQ ID NO: 740441 - DNA, 13 bp, C. elegans
tttcagcaccgcc

SEQ ID NO: 740442 - DNA, 13 bp, C. elegans
tttcagcactttt

SEQ ID NO: 740443 - DNA, 13 bp, C. elegans
tttcagcagaaaa

SEQ ID NO: 740444 - DNA, 13 bp, C. elegans
tttcagcagaaat

SEQ ID NO: 740445 - DNA, 13 bp, C. elegans
tttcagcagattt

SEQ ID NO: 740446 - DNA, 13 bp, C. elegans
tttcagcatcaaa

SEQ ID NO: 740447 - DNA, 13 bp, C. elegans
tttcagcattttc

SEQ ID NO: 740448 - DNA, 13 bp, C. elegans
tttcagcattttt

SEQ ID NO: 740449 - DNA, 14 bp, C. elegans
tttcagcatttttg

SEQ ID NO: 740450 - DNA, 13 bp, C. elegans
tttcagccaataa

SEQ ID NO: 740451 - DNA, 13 bp, C. elegans
tttcagccaattc

SEQ ID NO: 740452 - DNA, 13 bp, C. elegans
tttcagccaattt

SEQ ID NO: 740453 - DNA, 13 bp, C. elegans
tttcagccatttt

SEQ ID NO: 740454 - DNA, 13 bp, C. elegans
tttcagccgaaaa

SEQ ID NO: 740455 - DNA, 13 bp, C. elegans
tttcagccgtttt

SEQ ID NO: 740456 - DNA, 13 bp, C. elegans
tttcagccttttt

SEQ ID NO: 740457 - DNA, 13 bp, C. elegans
tttcagcgaaaaa

SEQ ID NO: 740458 - DNA, 13 bp, C. elegans
tttcagcgaattt

SEQ ID NO: 740459 - DNA, 13 bp, C. elegans
tttcagcgatttt

SEQ ID NO: 740460 - DNA, 13 bp, C. elegans
tttcagctatttt

SEQ ID NO: 740461 - DNA, 13 bp, C. elegans
tttcagctcactt

SEQ ID NO: 740462 - DNA, 13 bp, C. elegans
tttcagctcattt

SEQ ID NO: 740463 - DNA, 13 bp, C. elegans
tttcagctcgaaa

SEQ ID NO: 740464 - DNA, 13 bp, C. elegans
tttcagctgaaaa

SEQ ID NO: 740465 - DNA, 13 bp, C. elegans
tttcagctgaaat

SEQ ID NO: 740466 - DNA, 13 bp, C. elegans
tttcagctgattt

SEQ ID NO: 740467 - DNA, 13 bp, C. elegans
tttcagctggttg

SEQ ID NO: 740468 - DNA, 13 bp, C. elegans
tttcagctgtgtc

SEQ ID NO: 740469 - DNA, 13 bp, C. elegans
tttcagctgtttt

SEQ ID NO: 740470 - DNA, 13 bp, C. elegans
tttcagcttaatt

SEQ ID NO: 740471 - DNA, 13 bp, C. elegans
tttcagcttgttt

SEQ ID NO: 740472 - DNA, 13 bp, C. elegans
tttcagctttcaa

SEQ ID NO: 740473 - DNA, 13 bp, C. elegans
tttcagctttgaa

SEQ ID NO: 740474 - DNA, 13 bp, C. elegans
tttcagctttgtt

SEQ ID NO: 740475 - DNA, 13 bp, C. elegans
tttcagctttttc

SEQ ID NO: 740476 - DNA, 13 bp, C. elegans
tttcaggaaaaaa

SEQ ID NO: 740477 - DNA, 13 bp, C. elegans
tttcaggaaatga

SEQ ID NO: 740478 - DNA, 13 bp, C. elegans
tttcaggaagttt

SEQ ID NO: 740479 - DNA, 13 bp, C. elegans
tttcaggagaaaa

SEQ ID NO: 740480 - DNA, 13 bp, C. elegans
tttcaggagtttt

SEQ ID NO: 740481 - DNA, 13 bp, C. elegans
tttcaggataatt

SEQ ID NO: 740482 - DNA, 13 bp, C. elegans
tttcaggatttca

SEQ ID NO: 740483 - DNA, 13 bp, C. elegans
tttcaggcatttt

SEQ ID NO: 740484 - DNA, 13 bp, C. elegans
tttcaggccaaaa

SEQ ID NO: 740485 - DNA, 13 bp, C. elegans
tttcaggcgaaaa

SEQ ID NO: 740486 - DNA, 13 bp, C. elegans
tttcaggctttca

SEQ ID NO: 740487 - DNA, 13 bp, C. elegans
tttcagggtttca

SEQ ID NO: 740488 - DNA, 13 bp, C. elegans
tttcagggttttt

SEQ ID NO: 740489 - DNA, 13 bp, C. elegans
tttcaggtagaaa

SEQ ID NO: 740490 - DNA, 13 bp, C. elegans
tttcaggtgaaaa

SEQ ID NO: 740491 - DNA, 13 bp, C. elegans
tttcagtaaaaaa

SEQ ID NO: 740492 - DNA, 13 bp, C. elegans
tttcagtaaaata

SEQ ID NO: 740493 - DNA, 13 bp, C. elegans
tttcagtaaaatg

SEQ ID NO: 740494 - DNA, 13 bp, C. elegans
tttcagtaataaa

SEQ ID NO: 740495 - DNA, 13 bp, C. elegans
tttcagtaatatt

SEQ ID NO: 740496 - DNA, 13 bp, C. elegans
tttcagtaatttt

SEQ ID NO: 740497 - DNA, 13 bp, C. elegans
tttcagtaggtac

SEQ ID NO: 740498 - DNA, 14 bp, C. elegans
tttcagtagttttt

SEQ ID NO: 740499 - DNA, 13 bp, C. elegans
tttcagtatattt

SEQ ID NO: 740500 - DNA, 13 bp, C. elegans
tttcagtatcaaa

SEQ ID NO: 740501 - DNA, 13 bp, C. elegans
tttcagtatttta

SEQ ID NO: 740502 - DNA, 13 bp, C. elegans
tttcagtcaaaac

SEQ ID NO: 740503 - DNA, 13 bp, C. elegans
tttcagtcaacgt

SEQ ID NO: 740504 - DNA, 13 bp, C. elegans
tttcagtcaactt

SEQ ID NO: 740505 - DNA, 13 bp, C. elegans
tttcagtcaattt

SEQ ID NO: 740506 - DNA, 13 bp, C. elegans
tttcagtcagaaa

SEQ ID NO: 740507 - DNA, 13 bp, C. elegans
tttcagtcattta

SEQ ID NO: 740508 - DNA, 13 bp, C. elegans
tttcagtccaatt

SEQ ID NO: 740509 - DNA, 13 bp, C. elegans
tttcagtctgaaa

SEQ ID NO: 740510 - DNA, 13 bp, C. elegans
tttcagtgaattt

SEQ ID NO: 740511 - DNA, 13 bp, C. elegans
tttcagtgacttt

SEQ ID NO: 740512 - DNA, 13 bp, C. elegans
tttcagtgagttt

SEQ ID NO: 740513 - DNA, 13 bp, C. elegans
tttcagtgatatt

SEQ ID NO: 740514 - DNA, 13 bp, C. elegans
tttcagtgatctt

SEQ ID NO: 740515 - DNA, 13 bp, C. elegans
tttcagtgcaaaa

SEQ ID NO: 740516 - DNA, 13 bp, C. elegans
tttcagtgctttt

SEQ ID NO: 740517 - DNA, 13 bp, C. elegans
tttcagtgtttca

SEQ ID NO: 740518 - DNA, 13 bp, C. elegans
tttcagttaaaaa

SEQ ID NO: 740519 - DNA, 13 bp, C. elegans
tttcagttaaata

SEQ ID NO: 740520 - DNA, 13 bp, C. elegans
tttcagttaataa

SEQ ID NO: 740521 - DNA, 13 bp, C. elegans
tttcagttaattt

SEQ ID NO: 740522 - DNA, 13 bp, C. elegans
tttcagttagttt

SEQ ID NO: 740523 - DNA, 13 bp, C. elegans
tttcagttatatt

SEQ ID NO: 740524 - DNA, 13 bp, C. elegans
tttcagttattca

SEQ ID NO: 740525 - DNA, 13 bp, C. elegans
tttcagttatttg

SEQ ID NO: 740526 - DNA, 13 bp, C. elegans
tttcagttcatgg

SEQ ID NO: 740527 - DNA, 13 bp, C. elegans
tttcagttcattt

SEQ ID NO: 740528 - DNA, 13 bp, C. elegans
tttcagttgaaaa

SEQ ID NO: 740529 - DNA, 13 bp, C. elegans
tttcagttgaaac

SEQ ID NO: 740530 - DNA, 13 bp, C. elegans
tttcagttgaata

SEQ ID NO: 740531 - DNA, 13 bp, C. elegans
tttcagttgacaa

SEQ ID NO: 740532 - DNA, 13 bp, C. elegans
tttcagttgcaaa

SEQ ID NO: 740533 - DNA, 13 bp, C. elegans
tttcagttgttaa

SEQ ID NO: 740534 - DNA, 13 bp, C. elegans
tttcagtttaaaa

SEQ ID NO: 740535 - DNA, 13 bp, C. elegans
tttcagtttaaat

SEQ ID NO: 740536 - DNA, 13 bp, C. elegans
tttcagtttagaa

SEQ ID NO: 740537 - DNA, 13 bp, C. elegans
tttcagtttatga

SEQ ID NO: 740538 - DNA, 13 bp, C. elegans
tttcagtttcact

SEQ ID NO: 740539 - DNA, 13 bp, C. elegans
tttcagtttccaa

SEQ ID NO: 740540 - DNA, 13 bp, C. elegans
tttcagtttctct

SEQ ID NO: 740541 - DNA, 13 bp, C. elegans
tttcagtttctgt

SEQ ID NO: 740542 - DNA, 13 bp, C. elegans
tttcagtttgatc

SEQ ID NO: 740543 - DNA, 13 bp, C. elegans
tttcagtttgatt

SEQ ID NO: 740544 - DNA, 13 bp, C. elegans
tttcagtttggat

SEQ ID NO: 740545 - DNA, 13 bp, C. elegans
tttcagttttagt

SEQ ID NO: 740546 - DNA, 13 bp, C. elegans
tttcagttttccc

SEQ ID NO: 740547 - DNA, 13 bp, C. elegans
tttcagttttcct

SEQ ID NO: 740548 - DNA, 13 bp, C. elegans
tttcagttttcgg

SEQ ID NO: 740549 - DNA, 13 bp, C. elegans
tttcagttttgca

SEQ ID NO: 740550 - DNA, 13 bp, C. elegans
tttcagttttgct

SEQ ID NO: 740551 - DNA, 13 bp, C. elegans
tttcagtttttgc

SEQ ID NO: 740552 - DNA, 13 bp, C. elegans
tttcataaaatct

SEQ ID NO: 740553 - DNA, 13 bp, C. elegans
tttcataaacaat

SEQ ID NO: 740554 - DNA, 13 bp, C. elegans
tttcataaacttt

SEQ ID NO: 740555 - DNA, 13 bp, C. elegans
tttcataaattca

SEQ ID NO: 740556 - DNA, 13 bp, C. elegans
tttcataacattt

SEQ ID NO: 740557 - DNA, 13 bp, C. elegans
tttcataaccttt

SEQ ID NO: 740558 - DNA, 13 bp, C. elegans
tttcataacttta

SEQ ID NO: 740559 - DNA, 13 bp, C. elegans
tttcataagaaaa

SEQ ID NO: 740560 - DNA, 13 bp, C. elegans
tttcataagaatt

SEQ ID NO: 740561 - DNA, 13 bp, C. elegans
tttcataatgaaa

SEQ ID NO: 740562 - DNA, 13 bp, C. elegans
tttcataatgata

SEQ ID NO: 740563 - DNA, 13 bp, C. elegans
tttcataatggaa

SEQ ID NO: 740564 - DNA, 13 bp, C. elegans
tttcataatgttt

SEQ ID NO: 740565 - DNA, 13 bp, C. elegans
tttcataattcca

SEQ ID NO: 740566 - DNA, 13 bp, C. elegans
tttcataattcta

SEQ ID NO: 740567 - DNA, 13 bp, C. elegans
tttcatacaaaaa

SEQ ID NO: 740568 - DNA, 13 bp, C. elegans
tttcatacaaatt

SEQ ID NO: 740569 - DNA, 13 bp, C. elegans
tttcatacaactt

SEQ ID NO: 740570 - DNA, 13 bp, C. elegans
tttcatacaattt

SEQ ID NO: 740571 - DNA, 13 bp, C. elegans
tttcatacgtttt

SEQ ID NO: 740572 - DNA, 13 bp, C. elegans
tttcatagaaaaa

SEQ ID NO: 740573 - DNA, 13 bp, C. elegans
tttcatagaatat

SEQ ID NO: 740574 - DNA, 13 bp, C. elegans
tttcatagaattt

SEQ ID NO: 740575 - DNA, 13 bp, C. elegans
tttcatagatttt

SEQ ID NO: 740576 - DNA, 13 bp, C. elegans
tttcatagttgtt

SEQ ID NO: 740577 - DNA, 13 bp, C. elegans
tttcatataaaac

SEQ ID NO: 740578 - DNA, 13 bp, C. elegans
tttcatataaact

SEQ ID NO: 740579 - DNA, 13 bp, C. elegans
tttcatatacaaa

SEQ ID NO: 740580 - DNA, 13 bp, C. elegans
tttcatatcaaaa

SEQ ID NO: 740581 - DNA, 14 bp, C. elegans
tttcatatcaaatt

SEQ ID NO: 740582 - DNA, 13 bp, C. elegans
tttcatatcgaaa

SEQ ID NO: 740583 - DNA, 13 bp, C. elegans
tttcatattcagt

SEQ ID NO: 740584 - DNA, 13 bp, C. elegans
tttcatattgatt

SEQ ID NO: 740585 - DNA, 14 bp, C. elegans
tttcatatttcagc

SEQ ID NO: 740586 - DNA, 13 bp, C. elegans
tttcatatttctg

SEQ ID NO: 740587 - DNA, 13 bp, C. elegans
tttcatattttcg

SEQ ID NO: 740588 - DNA, 13 bp, C. elegans
tttcatattttga

SEQ ID NO: 740589 - DNA, 13 bp, C. elegans
tttcatcaaaaaa

SEQ ID NO: 740590 - DNA, 13 bp, C. elegans
tttcatcaaaatt

SEQ ID NO: 740591 - DNA, 13 bp, C. elegans
tttcatcaaacat

SEQ ID NO: 740592 - DNA, 13 bp, C. elegans
tttcatcaaactt

SEQ ID NO: 740593 - DNA, 13 bp, C. elegans
tttcatcaataaa

SEQ ID NO: 740594 - DNA, 13 bp, C. elegans
tttcatcaatatt

SEQ ID NO: 740595 - DNA, 13 bp, C. elegans
tttcatcaatgat

SEQ ID NO: 740596 - DNA, 13 bp, C. elegans
tttcatcaattat

SEQ ID NO: 740597 - DNA, 13 bp, C. elegans
tttcatcaattta

SEQ ID NO: 740598 - DNA, 13 bp, C. elegans
tttcatcagaaaa

SEQ ID NO: 740599 - DNA, 13 bp, C. elegans
tttcatcaggaaa

SEQ ID NO: 740600 - DNA, 13 bp, C. elegans
tttcatcagtttt

SEQ ID NO: 740601 - DNA, 13 bp, C. elegans
tttcatcattaaa

SEQ ID NO: 740602 - DNA, 13 bp, C. elegans
tttcatccaaaat

SEQ ID NO: 740603 - DNA, 13 bp, C. elegans
tttcatccaattt

SEQ ID NO: 740604 - DNA, 13 bp, C. elegans
tttcatccatttc

SEQ ID NO: 740605 - DNA, 13 bp, C. elegans
tttcatccgaaaa

SEQ ID NO: 740606 - DNA, 13 bp, C. elegans
tttcatcgaaaaa

SEQ ID NO: 740607 - DNA, 13 bp, C. elegans
tttcatcgaattt

SEQ ID NO: 740608 - DNA, 13 bp, C. elegans
tttcatcgagttt

SEQ ID NO: 740609 - DNA, 13 bp, C. elegans
tttcatcgataaa

SEQ ID NO: 740610 - DNA, 13 bp, C. elegans
tttcatcgatttt

SEQ ID NO: 740611 - DNA, 13 bp, C. elegans
tttcatcgcaaaa

SEQ ID NO: 740612 - DNA, 13 bp, C. elegans
tttcatcgctttt

SEQ ID NO: 740613 - DNA, 13 bp, C. elegans
tttcatcggaaaa

SEQ ID NO: 740614 - DNA, 13 bp, C. elegans
tttcatcgttttc

SEQ ID NO: 740615 - DNA, 13 bp, C. elegans
tttcatctaaata

SEQ ID NO: 740616 - DNA, 13 bp, C. elegans
tttcatctagttt

SEQ ID NO: 740617 - DNA, 13 bp, C. elegans
tttcatctcaaaa

SEQ ID NO: 740618 - DNA, 13 bp, C. elegans
tttcatctcaatt

SEQ ID NO: 740619 - DNA, 13 bp, C. elegans
tttcatctgaaaa

SEQ ID NO: 740620 - DNA, 13 bp, C. elegans
tttcatctgaaat

SEQ ID NO: 740621 - DNA, 13 bp, C. elegans
tttcatcttcaaa

SEQ ID NO: 740622 - DNA, 13 bp, C. elegans
tttcatcttgaaa

SEQ ID NO: 740623 - DNA, 13 bp, C. elegans
tttcatgaaaact

SEQ ID NO: 740624 - DNA, 13 bp, C. elegans
tttcatgaaaatt

SEQ ID NO: 740625 - DNA, 13 bp, C. elegans
tttcatgaaactg

SEQ ID NO: 740626 - DNA, 13 bp, C. elegans
tttcatgaacttt

SEQ ID NO: 740627 - DNA, 13 bp, C. elegans
tttcatgaagaaa

SEQ ID NO: 740628 - DNA, 13 bp, C. elegans
tttcatgaagttt

SEQ ID NO: 740629 - DNA, 13 bp, C. elegans
tttcatgaatatt

SEQ ID NO: 740630 - DNA, 13 bp, C. elegans
tttcatgacaatt

SEQ ID NO: 740631 - DNA, 13 bp, C. elegans
tttcatgactttt

SEQ ID NO: 740632 - DNA, 13 bp, C. elegans
tttcatgatcgaa

SEQ ID NO: 740633 - DNA, 13 bp, C. elegans
tttcatgatgttt

SEQ ID NO: 740634 - DNA, 13 bp, C. elegans
tttcatgatttct

SEQ ID NO: 740635 - DNA, 13 bp, C. elegans
tttcatgattttc

SEQ ID NO: 740636 - DNA, 13 bp, C. elegans
tttcatgcaaatt

SEQ ID NO: 740637 - DNA, 13 bp, C. elegans
tttcatgcaattt

SEQ ID NO: 740638 - DNA, 13 bp, C. elegans
tttcatgcagaaa

SEQ ID NO: 740639 - DNA, 13 bp, C. elegans
tttcatgctgaaa

SEQ ID NO: 740640 - DNA, 13 bp, C. elegans
tttcatgcttttc

SEQ ID NO: 740641 - DNA, 13 bp, C. elegans
tttcatggaaaat

SEQ ID NO: 740642 - DNA, 13 bp, C. elegans
tttcatggaaatt

SEQ ID NO: 740643 - DNA, 13 bp, C. elegans
tttcatgggaaaa

SEQ ID NO: 740644 - DNA, 13 bp, C. elegans
tttcatggttttc

SEQ ID NO: 740645 - DNA, 13 bp, C. elegans
tttcatgtgaaaa

SEQ ID NO: 740646 - DNA, 13 bp, C. elegans
tttcatgtgataa

SEQ ID NO: 740647 - DNA, 13 bp, C. elegans
tttcatgttcaat

SEQ ID NO: 740648 - DNA, 13 bp, C. elegans
tttcatgtttctc

SEQ ID NO: 740649 - DNA, 13 bp, C. elegans
tttcatgtttgaa

SEQ ID NO: 740650 - DNA, 13 bp, C. elegans
tttcatgttttca

SEQ ID NO: 740651 - DNA, 13 bp, C. elegans
tttcattaaaaac

SEQ ID NO: 740652 - DNA, 13 bp, C. elegans
tttcattaaaatc

SEQ ID NO: 740653 - DNA, 13 bp, C. elegans
tttcattaactaa

SEQ ID NO: 740654 - DNA, 13 bp, C. elegans
tttcattaagttt

SEQ ID NO: 740655 - DNA, 13 bp, C. elegans
tttcattaataac

SEQ ID NO: 740656 - DNA, 13 bp, C. elegans
tttcattaattca

SEQ ID NO: 740657 - DNA, 13 bp, C. elegans
tttcattacaaaa

SEQ ID NO: 740658 - DNA, 13 bp, C. elegans
tttcattagaatt

SEQ ID NO: 740659 - DNA, 13 bp, C. elegans
tttcattagtttc

SEQ ID NO: 740660 - DNA, 13 bp, C. elegans
tttcattattgat

SEQ ID NO: 740661 - DNA, 13 bp, C. elegans
tttcattcaaaaa

SEQ ID NO: 740662 - DNA, 13 bp, C. elegans
tttcattcaaaat

SEQ ID NO: 740663 - DNA, 13 bp, C. elegans
tttcattcaaagt

SEQ ID NO: 740664 - DNA, 13 bp, C. elegans
tttcattcaacat

SEQ ID NO: 740665 - DNA, 13 bp, C. elegans
tttcattcaagaa

SEQ ID NO: 740666 - DNA, 13 bp, C. elegans
tttcattcagaaa

SEQ ID NO: 740667 - DNA, 13 bp, C. elegans
tttcattcattca

SEQ ID NO: 740668 - DNA, 13 bp, C. elegans
tttcattcgattc

SEQ ID NO: 740669 - DNA, 13 bp, C. elegans
tttcattcgattt

SEQ ID NO: 740670 - DNA, 13 bp, C. elegans
tttcattctaaaa

SEQ ID NO: 740671 - DNA, 13 bp, C. elegans
tttcattcttcca

SEQ ID NO: 740672 - DNA, 13 bp, C. elegans
tttcattgaaaat

SEQ ID NO: 740673 - DNA, 13 bp, C. elegans
tttcattgaaata

SEQ ID NO: 740674 - DNA, 13 bp, C. elegans
tttcattgaattt

SEQ ID NO: 740675 - DNA, 13 bp, C. elegans
tttcattgacttt

SEQ ID NO: 740676 - DNA, 13 bp, C. elegans
tttcattgataaa

SEQ ID NO: 740677 - DNA, 13 bp, C. elegans
tttcattgatttc

SEQ ID NO: 740678 - DNA, 13 bp, C. elegans
tttcattgatttg

SEQ ID NO: 740679 - DNA, 13 bp, C. elegans
tttcattgcaaaa

SEQ ID NO: 740680 - DNA, 13 bp, C. elegans
tttcattggaaat

SEQ ID NO: 740681 - DNA, 13 bp, C. elegans
tttcattggattt

SEQ ID NO: 740682 - DNA, 13 bp, C. elegans
tttcattgtatta

SEQ ID NO: 740683 - DNA, 13 bp, C. elegans
tttcattgtgaaa

SEQ ID NO: 740684 - DNA, 13 bp, C. elegans
tttcattgttgaa

SEQ ID NO: 740685 - DNA, 13 bp, C. elegans
tttcattgtttca

SEQ ID NO: 740686 - DNA, 13 bp, C. elegans
tttcatttaacac

SEQ ID NO: 740687 - DNA, 13 bp, C. elegans
tttcatttacaaa

SEQ ID NO: 740688 - DNA, 13 bp, C. elegans
tttcatttattga

SEQ ID NO: 740689 - DNA, 13 bp, C. elegans
tttcatttcaaat

SEQ ID NO: 740690 - DNA, 13 bp, C. elegans
tttcatttcaata

SEQ ID NO: 740691 - DNA, 13 bp, C. elegans
tttcatttcagtt

SEQ ID NO: 740692 - DNA, 13 bp, C. elegans
tttcatttcctag

SEQ ID NO: 740693 - DNA, 13 bp, C. elegans
tttcatttcctgt

SEQ ID NO: 740694 - DNA, 13 bp, C. elegans
tttcatttctaga

SEQ ID NO: 740695 - DNA, 13 bp, C. elegans
tttcatttgaatt

SEQ ID NO: 740696 - DNA, 13 bp, C. elegans
tttcatttgcaaa

SEQ ID NO: 740697 - DNA, 13 bp, C. elegans
tttcatttggaaa

SEQ ID NO: 740698 - DNA, 13 bp, C. elegans
tttcatttggaag

SEQ ID NO: 740699 - DNA, 13 bp, C. elegans
tttcatttgtaaa

SEQ ID NO: 740700 - DNA, 13 bp, C. elegans
tttcatttgtcaa

SEQ ID NO: 740701 - DNA, 13 bp, C. elegans
tttcatttgtgca

SEQ ID NO: 740702 - DNA, 13 bp, C. elegans
tttcattttaagc

SEQ ID NO: 740703 - DNA, 13 bp, C. elegans
tttcattttatga

SEQ ID NO: 740704 - DNA, 13 bp, C. elegans
tttcattttcaac

SEQ ID NO: 740705 - DNA, 13 bp, C. elegans
tttcattttcaca

SEQ ID NO: 740706 - DNA, 13 bp, C. elegans
tttcattttccaa

SEQ ID NO: 740707 - DNA, 13 bp, C. elegans
tttcattttccga

SEQ ID NO: 740708 - DNA, 13 bp, C. elegans
tttcattttctgg

SEQ ID NO: 740709 - DNA, 13 bp, C. elegans
tttcattttgaca

SEQ ID NO: 740710 - DNA, 13 bp, C. elegans
tttcattttgatg

SEQ ID NO: 740711 - DNA, 13 bp, C. elegans
tttcattttgcaa

SEQ ID NO: 740712 - DNA, 13 bp, C. elegans
tttcattttggaa

SEQ ID NO: 740713 - DNA, 13 bp, C. elegans
tttcattttgtca

SEQ ID NO: 740714 - DNA, 13 bp, C. elegans
tttcatttttacg

SEQ ID NO: 740715 - DNA, 13 bp, C. elegans
tttcatttttgac

SEQ ID NO: 740716 - DNA, 13 bp, C. elegans
tttcatttttgga

SEQ ID NO: 740717 - DNA, 13 bp, C. elegans
tttccaaaaaaat

SEQ ID NO: 740718 - DNA, 13 bp, C. elegans
tttccaaaaaacc

SEQ ID NO: 740719 - DNA, 13 bp, C. elegans
tttccaaaaaaga

SEQ ID NO: 740720 - DNA, 13 bp, C. elegans
tttccaaaaaagt

SEQ ID NO: 740721 - DNA, 13 bp, C. elegans
tttccaaaaaatt

SEQ ID NO: 740722 - DNA, 13 bp, C. elegans
tttccaaaaactg

SEQ ID NO: 740723 - DNA, 13 bp, C. elegans
tttccaaaaactt

SEQ ID NO: 740724 - DNA, 13 bp, C. elegans
tttccaaaaagat

SEQ ID NO: 740725 - DNA, 13 bp, C. elegans
tttccaaaaataa

SEQ ID NO: 740726 - DNA, 13 bp, C. elegans
tttccaaaaatca

SEQ ID NO: 740727 - DNA, 13 bp, C. elegans
tttccaaaaatcc

SEQ ID NO: 740728 - DNA, 14 bp, C. elegans
tttccaaaaatttt

SEQ ID NO: 740729 - DNA, 13 bp, C. elegans
tttccaaaacatt

SEQ ID NO: 740730 - DNA, 13 bp, C. elegans
tttccaaaacgtt

SEQ ID NO: 740731 - DNA, 13 bp, C. elegans
tttccaaaacttc

SEQ ID NO: 740732 - DNA, 13 bp, C. elegans
tttccaaaagatt

SEQ ID NO: 740733 - DNA, 13 bp, C. elegans
tttccaaaagtta

SEQ ID NO: 740734 - DNA, 13 bp, C. elegans
tttccaaaatctc

SEQ ID NO: 740735 - DNA, 13 bp, C. elegans
tttccaaaatgcc

SEQ ID NO: 740736 - DNA, 13 bp, C. elegans
tttccaaaatgct

SEQ ID NO: 740737 - DNA, 13 bp, C. elegans
tttccaaaatgtt

SEQ ID NO: 740738 - DNA, 13 bp, C. elegans
tttccaaaattaa

SEQ ID NO: 740739 - DNA, 13 bp, C. elegans
tttccaaaattac

SEQ ID NO: 740740 - DNA, 13 bp, C. elegans
tttccaaaattta

SEQ ID NO: 740741 - DNA, 13 bp, C. elegans
tttccaaaatttg

SEQ ID NO: 740742 - DNA, 13 bp, C. elegans
tttccaaaatttt

SEQ ID NO: 740743 - DNA, 14 bp, C. elegans
tttccaaaattttg

SEQ ID NO: 740744 - DNA, 13 bp, C. elegans
tttccaaacaaaa

SEQ ID NO: 740745 - DNA, 13 bp, C. elegans
tttccaaacaaat

SEQ ID NO: 740746 - DNA, 13 bp, C. elegans
tttccaaacaata

SEQ ID NO: 740747 - DNA, 13 bp, C. elegans
tttccaaacaatt

SEQ ID NO: 740748 - DNA, 13 bp, C. elegans
tttccaaacattg

SEQ ID NO: 740749 - DNA, 13 bp, C. elegans
tttccaaacgttt

SEQ ID NO: 740750 - DNA, 13 bp, C. elegans
tttccaaacttgt

SEQ ID NO: 740751 - DNA, 14 bp, C. elegans
tttccaaacttttc

SEQ ID NO: 740752 - DNA, 13 bp, C. elegans
tttccaaagaaat

SEQ ID NO: 740753 - DNA, 13 bp, C. elegans
tttccaaagcttt

SEQ ID NO: 740754 - DNA, 13 bp, C. elegans
tttccaaaggttt

SEQ ID NO: 740755 - DNA, 13 bp, C. elegans
tttccaaagttca

SEQ ID NO: 740756 - DNA, 13 bp, C. elegans
tttccaaataaaa

SEQ ID NO: 740757 - DNA, 13 bp, C. elegans
tttccaaataatc

SEQ ID NO: 740758 - DNA, 13 bp, C. elegans
tttccaaatatca

SEQ ID NO: 740759 - DNA, 13 bp, C. elegans
tttccaaatattc

SEQ ID NO: 740760 - DNA, 13 bp, C. elegans
tttccaaatattt

SEQ ID NO: 740761 - DNA, 13 bp, C. elegans
tttccaaatctca

SEQ ID NO: 740762 - DNA, 13 bp, C. elegans
tttccaaatcttt

SEQ ID NO: 740763 - DNA, 13 bp, C. elegans
tttccaaatgaac

SEQ ID NO: 740764 - DNA, 13 bp, C. elegans
tttccaaatgttt

SEQ ID NO: 740765 - DNA, 13 bp, C. elegans
tttccaaattcaa

SEQ ID NO: 740766 - DNA, 13 bp, C. elegans
tttccaaattcac

SEQ ID NO: 740767 - DNA, 13 bp, C. elegans
tttccaaattcca

SEQ ID NO: 740768 - DNA, 13 bp, C. elegans
tttccaaattccc

SEQ ID NO: 740769 - DNA, 13 bp, C. elegans
tttccaaatttcg

SEQ ID NO: 740770 - DNA, 13 bp, C. elegans
tttccaaattttc

SEQ ID NO: 740771 - DNA, 13 bp, C. elegans
tttccaaattttg

SEQ ID NO: 740772 - DNA, 13 bp, C. elegans
tttccaacaaaac

SEQ ID NO: 740773 - DNA, 13 bp, C. elegans
tttccaacaaact

SEQ ID NO: 740774 - DNA, 13 bp, C. elegans
tttccaacattgt

SEQ ID NO: 740775 - DNA, 13 bp, C. elegans
tttccaacatttc

SEQ ID NO: 740776 - DNA, 13 bp, C. elegans
tttccaacatttt

SEQ ID NO: 740777 - DNA, 13 bp, C. elegans
tttccaaccaatc

SEQ ID NO: 740778 - DNA, 13 bp, C. elegans
tttccaaccattt

SEQ ID NO: 740779 - DNA, 13 bp, C. elegans
tttccaacgaaaa

SEQ ID NO: 740780 - DNA, 13 bp, C. elegans
tttccaactaatt

SEQ ID NO: 740781 - DNA, 13 bp, C. elegans
tttccaactattt

SEQ ID NO: 740782 - DNA, 13 bp, C. elegans
tttccaactcaaa

SEQ ID NO: 740783 - DNA, 13 bp, C. elegans
tttccaactcttc

SEQ ID NO: 740784 - DNA, 13 bp, C. elegans
tttccaactgaaa

SEQ ID NO: 740785 - DNA, 13 bp, C. elegans
tttccaacttatt

SEQ ID NO: 740786 - DNA, 13 bp, C. elegans
tttccaacttcta

SEQ ID NO: 740787 - DNA, 13 bp, C. elegans
tttccaacttctc

SEQ ID NO: 740788 - DNA, 13 bp, C. elegans
tttccaactttcc

SEQ ID NO: 740789 - DNA, 13 bp, C. elegans
tttccaactttct

SEQ ID NO: 740790 - DNA, 13 bp, C. elegans
tttccaacttttg

SEQ ID NO: 740791 - DNA, 13 bp, C. elegans
tttccaagaaaaa

SEQ ID NO: 740792 - DNA, 13 bp, C. elegans
tttccaagacaaa

SEQ ID NO: 740793 - DNA, 13 bp, C. elegans
tttccaagatttc

SEQ ID NO: 740794 - DNA, 13 bp, C. elegans
tttccaagatttt

SEQ ID NO: 740795 - DNA, 13 bp, C. elegans
tttccaagctttt

SEQ ID NO: 740796 - DNA, 13 bp, C. elegans
tttccaaggaaaa

SEQ ID NO: 740797 - DNA, 13 bp, C. elegans
tttccaaggattt

SEQ ID NO: 740798 - DNA, 13 bp, C. elegans
tttccaagtattt

SEQ ID NO: 740799 - DNA, 14 bp, C. elegans
tttccaagtgaaaa

SEQ ID NO: 740800 - DNA, 13 bp, C. elegans
tttccaagttcaa

SEQ ID NO: 740801 - DNA, 13 bp, C. elegans
tttccaagtttca

SEQ ID NO: 740802 - DNA, 13 bp, C. elegans
tttccaagttttc

SEQ ID NO: 740803 - DNA, 14 bp, C. elegans
tttccaagttttct

SEQ ID NO: 740804 - DNA, 13 bp, C. elegans
tttccaagttttt

SEQ ID NO: 740805 - DNA, 13 bp, C. elegans
tttccaataaaac

SEQ ID NO: 740806 - DNA, 13 bp, C. elegans
tttccaataaatt

SEQ ID NO: 740807 - DNA, 13 bp, C. elegans
tttccaataattc

SEQ ID NO: 740808 - DNA, 13 bp, C. elegans
tttccaataattg

SEQ ID NO: 740809 - DNA, 13 bp, C. elegans
tttccaataattt

SEQ ID NO: 740810 - DNA, 13 bp, C. elegans
tttccaatatcga

SEQ ID NO: 740811 - DNA, 13 bp, C. elegans
tttccaatattat

SEQ ID NO: 740812 - DNA, 13 bp, C. elegans
tttccaatatttg

SEQ ID NO: 740813 - DNA, 13 bp, C. elegans
tttccaatcaaaa

SEQ ID NO: 740814 - DNA, 13 bp, C. elegans
tttccaatcaaat

SEQ ID NO: 740815 - DNA, 13 bp, C. elegans
tttccaatcaata

SEQ ID NO: 740816 - DNA, 13 bp, C. elegans
tttccaatctaaa

SEQ ID NO: 740817 - DNA, 13 bp, C. elegans
tttccaatcttca

SEQ ID NO: 740818 - DNA, 13 bp, C. elegans
tttccaatctttc

SEQ ID NO: 740819 - DNA, 13 bp, C. elegans
tttccaatgattt

SEQ ID NO: 740820 - DNA, 13 bp, C. elegans
tttccaatgtttt

SEQ ID NO: 740821 - DNA, 13 bp, C. elegans
tttccaattaaaa

SEQ ID NO: 740822 - DNA, 13 bp, C. elegans
tttccaattaaat

SEQ ID NO: 740823 - DNA, 14 bp, C. elegans
tttccaattaattt

SEQ ID NO: 740824 - DNA, 13 bp, C. elegans
tttccaattcata

SEQ ID NO: 740825 - DNA, 13 bp, C. elegans
tttccaattggaa

SEQ ID NO: 740826 - DNA, 13 bp, C. elegans
tttccaatttaaa

SEQ ID NO: 740827 - DNA, 13 bp, C. elegans
tttccaatttatc

SEQ ID NO: 740828 - DNA, 13 bp, C. elegans
tttccaatttcag

SEQ ID NO: 740829 - DNA, 13 bp, C. elegans
tttccaatttggt

SEQ ID NO: 740830 - DNA, 13 bp, C. elegans
tttccaatttgtg

SEQ ID NO: 740831 - DNA, 14 bp, C. elegans
tttccaattttcaa

SEQ ID NO: 740832 - DNA, 13 bp, C. elegans
tttccaattttcc

SEQ ID NO: 740833 - DNA, 14 bp, C. elegans
tttccaattttcct

SEQ ID NO: 740834 - DNA, 13 bp, C. elegans
tttccaattttcg

SEQ ID NO: 740835 - DNA, 13 bp, C. elegans
tttccacaaaaaa

SEQ ID NO: 740836 - DNA, 13 bp, C. elegans
tttccacaaaaac

SEQ ID NO: 740837 - DNA, 13 bp, C. elegans
tttccacaaaaat

SEQ ID NO: 740838 - DNA, 13 bp, C. elegans
tttccacaaaatt

SEQ ID NO: 740839 - DNA, 13 bp, C. elegans
tttccacaaactt

SEQ ID NO: 740840 - DNA, 13 bp, C. elegans
tttccacaaattt

SEQ ID NO: 740841 - DNA, 13 bp, C. elegans
tttccacaagttt

SEQ ID NO: 740842 - DNA, 13 bp, C. elegans
tttccacaatatt

SEQ ID NO: 740843 - DNA, 13 bp, C. elegans
tttccacaatttt

SEQ ID NO: 740844 - DNA, 13 bp, C. elegans
tttccacagaaaa

SEQ ID NO: 740845 - DNA, 13 bp, C. elegans
tttccacattttc

SEQ ID NO: 740846 - DNA, 13 bp, C. elegans
tttccaccaaaaa

SEQ ID NO: 740847 - DNA, 13 bp, C. elegans
tttccacccaaaa

SEQ ID NO: 740848 - DNA, 13 bp, C. elegans
tttccacccaatt

SEQ ID NO: 740849 - DNA, 13 bp, C. elegans
tttccaccgaaaa

SEQ ID NO: 740850 - DNA, 13 bp, C. elegans
tttccaccgaaat

SEQ ID NO: 740851 - DNA, 13 bp, C. elegans
tttccacctaaaa

SEQ ID NO: 740852 - DNA, 13 bp, C. elegans
tttccacctgttt

SEQ ID NO: 740853 - DNA, 13 bp, C. elegans
tttccacgatttt

SEQ ID NO: 740854 - DNA, 13 bp, C. elegans
tttccacggaaaa

SEQ ID NO: 740855 - DNA, 13 bp, C. elegans
tttccacggattt

SEQ ID NO: 740856 - DNA, 13 bp, C. elegans
tttccactaattt

SEQ ID NO: 740857 - DNA, 13 bp, C. elegans
tttccactcaaaa

SEQ ID NO: 740858 - DNA, 13 bp, C. elegans
tttccactcaaat

SEQ ID NO: 740859 - DNA, 13 bp, C. elegans
tttccactcaatt

SEQ ID NO: 740860 - DNA, 13 bp, C. elegans
tttccactcattt

SEQ ID NO: 740861 - DNA, 13 bp, C. elegans
tttccactgaatt

SEQ ID NO: 740862 - DNA, 13 bp, C. elegans
tttccactgtttt

SEQ ID NO: 740863 - DNA, 13 bp, C. elegans
tttccacttcaaa

SEQ ID NO: 740864 - DNA, 13 bp, C. elegans
tttccacttgaaa

SEQ ID NO: 740865 - DNA, 13 bp, C. elegans
tttccacttttaa

SEQ ID NO: 740866 - DNA, 13 bp, C. elegans
tttccagaaaaaa

SEQ ID NO: 740867 - DNA, 13 bp, C. elegans
tttccagaaaatc

SEQ ID NO: 740868 - DNA, 13 bp, C. elegans
tttccagaaaatt

SEQ ID NO: 740869 - DNA, 13 bp, C. elegans
tttccagaaactt

SEQ ID NO: 740870 - DNA, 13 bp, C. elegans
tttccagaaatgt

SEQ ID NO: 740871 - DNA, 13 bp, C. elegans
tttccagaaattc

SEQ ID NO: 740872 - DNA, 13 bp, C. elegans
tttccagaacaaa

SEQ ID NO: 740873 - DNA, 13 bp, C. elegans
tttccagaagatt

SEQ ID NO: 740874 - DNA, 13 bp, C. elegans
tttccagaagttt

SEQ ID NO: 740875 - DNA, 13 bp, C. elegans
tttccagaattca

SEQ ID NO: 740876 - DNA, 13 bp, C. elegans
tttccagaatttt

SEQ ID NO: 740877 - DNA, 13 bp, C. elegans
tttccagagaaat

SEQ ID NO: 740878 - DNA, 13 bp, C. elegans
tttccagagtttt

SEQ ID NO: 740879 - DNA, 13 bp, C. elegans
tttccagatattc

SEQ ID NO: 740880 - DNA, 13 bp, C. elegans
tttccagatattt

SEQ ID NO: 740881 - DNA, 13 bp, C. elegans
tttccagatcttt

SEQ ID NO: 740882 - DNA, 13 bp, C. elegans
tttccagatgaaa

SEQ ID NO: 740883 - DNA, 13 bp, C. elegans
tttccagattttc

SEQ ID NO: 740884 - DNA, 13 bp, C. elegans
tttccagattttt

SEQ ID NO: 740885 - DNA, 13 bp, C. elegans
tttccagcaaaaa

SEQ ID NO: 740886 - DNA, 13 bp, C. elegans
tttccagcaattt

SEQ ID NO: 740887 - DNA, 13 bp, C. elegans
tttccagcatttt

SEQ ID NO: 740888 - DNA, 13 bp, C. elegans
tttccagccgaaa

SEQ ID NO: 740889 - DNA, 13 bp, C. elegans
tttccagctaatt

SEQ ID NO: 740890 - DNA, 13 bp, C. elegans
tttccagcttttt

SEQ ID NO: 740891 - DNA, 13 bp, C. elegans
tttccagtgaaaa

SEQ ID NO: 740892 - DNA, 13 bp, C. elegans
tttccagttgttt

SEQ ID NO: 740893 - DNA, 13 bp, C. elegans
tttccagtttcaa

SEQ ID NO: 740894 - DNA, 13 bp, C. elegans
tttccagtttcca

SEQ ID NO: 740895 - DNA, 13 bp, C. elegans
tttccagtttgtt

SEQ ID NO: 740896 - DNA, 13 bp, C. elegans
tttccagttttat

SEQ ID NO: 740897 - DNA, 13 bp, C. elegans
tttccagttttcg

SEQ ID NO: 740898 - DNA, 13 bp, C. elegans
tttccagttttgt

SEQ ID NO: 740899 - DNA, 13 bp, C. elegans
tttccataaaaag

SEQ ID NO: 740900 - DNA, 13 bp, C. elegans
tttccataaaaat

SEQ ID NO: 740901 - DNA, 13 bp, C. elegans
tttccataaaatc

SEQ ID NO: 740902 - DNA, 13 bp, C. elegans
tttccataagttt

SEQ ID NO: 740903 - DNA, 13 bp, C. elegans
tttccataatttc

SEQ ID NO: 740904 - DNA, 13 bp, C. elegans
tttccatacaaaa

SEQ ID NO: 740905 - DNA, 13 bp, C. elegans
tttccatacattt

SEQ ID NO: 740906 - DNA, 13 bp, C. elegans
tttccatagtttc

SEQ ID NO: 740907 - DNA, 13 bp, C. elegans
tttccatatcaaa

SEQ ID NO: 740908 - DNA, 13 bp, C. elegans
tttccatattctc

SEQ ID NO: 740909 - DNA, 13 bp, C. elegans
tttccatatttca

SEQ ID NO: 740910 - DNA, 13 bp, C. elegans
tttccatcaaaat

SEQ ID NO: 740911 - DNA, 13 bp, C. elegans
tttccatcaaatt

SEQ ID NO: 740912 - DNA, 13 bp, C. elegans
tttccatcaattt

SEQ ID NO: 740913 - DNA, 13 bp, C. elegans
tttccatcgaaaa

SEQ ID NO: 740914 - DNA, 13 bp, C. elegans
tttccatctgaaa

SEQ ID NO: 740915 - DNA, 13 bp, C. elegans
tttccatgaattt

SEQ ID NO: 740916 - DNA, 13 bp, C. elegans
tttccatgatttc

SEQ ID NO: 740917 - DNA, 13 bp, C. elegans
tttccatgatttt

SEQ ID NO: 740918 - DNA, 13 bp, C. elegans
tttccatggaaac

SEQ ID NO: 740919 - DNA, 13 bp, C. elegans
tttccatggattt

SEQ ID NO: 740920 - DNA, 13 bp, C. elegans
tttccatgtttca

SEQ ID NO: 740921 - DNA, 13 bp, C. elegans
tttccatgtttcc

SEQ ID NO: 740922 - DNA, 13 bp, C. elegans
tttccatgttttg

SEQ ID NO: 740923 - DNA, 13 bp, C. elegans
tttccattaaaaa

SEQ ID NO: 740924 - DNA, 13 bp, C. elegans
tttccattcaaac

SEQ ID NO: 740925 - DNA, 13 bp, C. elegans
tttccattccaaa

SEQ ID NO: 740926 - DNA, 13 bp, C. elegans
tttccattgaaaa

SEQ ID NO: 740927 - DNA, 13 bp, C. elegans
tttccattgattt

SEQ ID NO: 740928 - DNA, 13 bp, C. elegans
tttccattgcaaa

SEQ ID NO: 740929 - DNA, 13 bp, C. elegans
tttccattggaat

SEQ ID NO: 740930 - DNA, 13 bp, C. elegans
tttccattgtttc

SEQ ID NO: 740931 - DNA, 13 bp, C. elegans
tttccatttaaaa

SEQ ID NO: 740932 - DNA, 13 bp, C. elegans
tttccatttcaaa

SEQ ID NO: 740933 - DNA, 13 bp, C. elegans
tttccatttccat

SEQ ID NO: 740934 - DNA, 13 bp, C. elegans
tttccatttccca

SEQ ID NO: 740935 - DNA, 13 bp, C. elegans
tttccatttgaaa

SEQ ID NO: 740936 - DNA, 13 bp, C. elegans
tttccatttgatt

SEQ ID NO: 740937 - DNA, 13 bp, C. elegans
tttccatttgcac

SEQ ID NO: 740938 - DNA, 13 bp, C. elegans
tttccattttaaa

SEQ ID NO: 740939 - DNA, 13 bp, C. elegans
tttccattttaga

SEQ ID NO: 740940 - DNA, 13 bp, C. elegans
tttccattttcag

SEQ ID NO: 740941 - DNA, 13 bp, C. elegans
tttccattttctg

SEQ ID NO: 740942 - DNA, 13 bp, C. elegans
tttccatttttag

SEQ ID NO: 740943 - DNA, 13 bp, C. elegans
tttccatttttgc

SEQ ID NO: 740944 - DNA, 13 bp, C. elegans
tttcccaaaaaag

SEQ ID NO: 740945 - DNA, 13 bp, C. elegans
tttcccaaaaaat

SEQ ID NO: 740946 - DNA, 13 bp, C. elegans
tttcccaaaaata

SEQ ID NO: 740947 - DNA, 13 bp, C. elegans
tttcccaaaaatt

SEQ ID NO: 740948 - DNA, 13 bp, C. elegans
tttcccaaaacct

SEQ ID NO: 740949 - DNA, 13 bp, C. elegans
tttcccaaaataa

SEQ ID NO: 740950 - DNA, 13 bp, C. elegans
tttcccaacaaaa

SEQ ID NO: 740951 - DNA, 13 bp, C. elegans
tttcccaacttct

SEQ ID NO: 740952 - DNA, 13 bp, C. elegans
tttcccaatattt

SEQ ID NO: 740953 - DNA, 13 bp, C. elegans
tttcccaattctt

SEQ ID NO: 740954 - DNA, 13 bp, C. elegans
tttcccaattgtt

SEQ ID NO: 740955 - DNA, 13 bp, C. elegans
tttcccaatttaa

SEQ ID NO: 740956 - DNA, 13 bp, C. elegans
tttcccacaaaaa

SEQ ID NO: 740957 - DNA, 13 bp, C. elegans
tttcccacaattt

SEQ ID NO: 740958 - DNA, 13 bp, C. elegans
tttcccacatttt

SEQ ID NO: 740959 - DNA, 13 bp, C. elegans
tttcccacgattt

SEQ ID NO: 740960 - DNA, 13 bp, C. elegans
tttcccactaaaa

SEQ ID NO: 740961 - DNA, 13 bp, C. elegans
tttcccacttgct

SEQ ID NO: 740962 - DNA, 13 bp, C. elegans
tttcccagaaaat

SEQ ID NO: 740963 - DNA, 13 bp, C. elegans
tttcccagttttc

SEQ ID NO: 740964 - DNA, 13 bp, C. elegans
tttcccataaaaa

SEQ ID NO: 740965 - DNA, 13 bp, C. elegans
tttcccatcaaaa

SEQ ID NO: 740966 - DNA, 13 bp, C. elegans
tttcccattaaaa

SEQ ID NO: 740967 - DNA, 13 bp, C. elegans
tttcccattgctc

SEQ ID NO: 740968 - DNA, 13 bp, C. elegans
tttcccatttcaa

SEQ ID NO: 740969 - DNA, 13 bp, C. elegans
tttcccattttca

SEQ ID NO: 740970 - DNA, 13 bp, C. elegans
tttccccaaaaac

SEQ ID NO: 740971 - DNA, 13 bp, C. elegans
tttccccaaaatt

SEQ ID NO: 740972 - DNA, 13 bp, C. elegans
tttccccaaataa

SEQ ID NO: 740973 - DNA, 13 bp, C. elegans
tttccccaatttt

SEQ ID NO: 740974 - DNA, 13 bp, C. elegans
tttccccagattt

SEQ ID NO: 740975 - DNA, 13 bp, C. elegans
tttccccataaaa

SEQ ID NO: 740976 - DNA, 13 bp, C. elegans
tttccccatattt

SEQ ID NO: 740977 - DNA, 13 bp, C. elegans
tttcccccaattt

SEQ ID NO: 740978 - DNA, 13 bp, C. elegans
tttccccgaaatt

SEQ ID NO: 740979 - DNA, 13 bp, C. elegans
tttccccgaattt

SEQ ID NO: 740980 - DNA, 13 bp, C. elegans
tttcccctaaaat

SEQ ID NO: 740981 - DNA, 13 bp, C. elegans
tttcccctcaaaa

SEQ ID NO: 740982 - DNA, 13 bp, C. elegans
tttcccctgaaaa

SEQ ID NO: 740983 - DNA, 13 bp, C. elegans
tttcccgaaaaaa

SEQ ID NO: 740984 - DNA, 13 bp, C. elegans
tttcccgaaaaat

SEQ ID NO: 740985 - DNA, 13 bp, C. elegans
tttcccgaaattt

SEQ ID NO: 740986 - DNA, 13 bp, C. elegans
tttcccgaatttt

SEQ ID NO: 740987 - DNA, 13 bp, C. elegans
tttcccgattttc

SEQ ID NO: 740988 - DNA, 13 bp, C. elegans
tttcccgattttt

SEQ ID NO: 740989 - DNA, 13 bp, C. elegans
tttcccgcaaaaa

SEQ ID NO: 740990 - DNA, 13 bp, C. elegans
tttcccgcaaatc

SEQ ID NO: 740991 - DNA, 13 bp, C. elegans
tttcccgcatttt

SEQ ID NO: 740992 - DNA, 13 bp, C. elegans
tttcccgccgaaa

SEQ ID NO: 740993 - DNA, 13 bp, C. elegans
tttcccgctaaaa

SEQ ID NO: 740994 - DNA, 13 bp, C. elegans
tttcccgcttaaa

SEQ ID NO: 740995 - DNA, 13 bp, C. elegans
tttcccggaaaaa

SEQ ID NO: 740996 - DNA, 13 bp, C. elegans
tttcccggaaaat

SEQ ID NO: 740997 - DNA, 13 bp, C. elegans
tttcccggaaatt

SEQ ID NO: 740998 - DNA, 14 bp, C. elegans
tttcccgtggtgga

SEQ ID NO: 740999 - DNA, 13 bp, C. elegans
tttcccgttctga

SEQ ID NO: 741000 - DNA, 13 bp, C. elegans
tttccctaaaact

SEQ ID NO: 741001 - DNA, 13 bp, C. elegans
tttccctaaaatt

SEQ ID NO: 741002 - DNA, 13 bp, C. elegans
tttccctattgcc

SEQ ID NO: 741003 - DNA, 13 bp, C. elegans
tttccctcaaaaa

SEQ ID NO: 741004 - DNA, 13 bp, C. elegans
tttccctcaaatt

SEQ ID NO: 741005 - DNA, 13 bp, C. elegans
tttccctgaaaac

SEQ ID NO: 741006 - DNA, 13 bp, C. elegans
tttcccttccaaa

SEQ ID NO: 741007 - DNA, 13 bp, C. elegans
tttcccttttaaa

SEQ ID NO: 741008 - DNA, 13 bp, C. elegans
tttcccttttcaa

SEQ ID NO: 741009 - DNA, 13 bp, C. elegans
tttccctttttga

SEQ ID NO: 741010 - DNA, 13 bp, C. elegans
tttccgaaaaagt

SEQ ID NO: 741011 - DNA, 13 bp, C. elegans
tttccgaaaaatg

SEQ ID NO: 741012 - DNA, 13 bp, C. elegans
tttccgaaaataa

SEQ ID NO: 741013 - DNA, 13 bp, C. elegans
tttccgaaaatct

SEQ ID NO: 741014 - DNA, 13 bp, C. elegans
tttccgaaacatt

SEQ ID NO: 741015 - DNA, 13 bp, C. elegans
tttccgaaactac

SEQ ID NO: 741016 - DNA, 13 bp, C. elegans
tttccgaaagttt

SEQ ID NO: 741017 - DNA, 13 bp, C. elegans
tttccgaaattgt

SEQ ID NO: 741018 - DNA, 13 bp, C. elegans
tttccgaaatttc

SEQ ID NO: 741019 - DNA, 13 bp, C. elegans
tttccgaaatttt

SEQ ID NO: 741020 - DNA, 13 bp, C. elegans
tttccgaactttt

SEQ ID NO: 741021 - DNA, 13 bp, C. elegans
tttccgaataaaa

SEQ ID NO: 741022 - DNA, 13 bp, C. elegans
tttccgaatattt

SEQ ID NO: 741023 - DNA, 13 bp, C. elegans
tttccgaattgcc

SEQ ID NO: 741024 - DNA, 13 bp, C. elegans
tttccgaatttcc

SEQ ID NO: 741025 - DNA, 13 bp, C. elegans
tttccgaatttga

SEQ ID NO: 741026 - DNA, 13 bp, C. elegans
tttccgaatttgt

SEQ ID NO: 741027 - DNA, 13 bp, C. elegans
tttccgaattttc

SEQ ID NO: 741028 - DNA, 13 bp, C. elegans
tttccgaattttg

SEQ ID NO: 741029 - DNA, 13 bp, C. elegans
tttccgacaaact

SEQ ID NO: 741030 - DNA, 13 bp, C. elegans
tttccgacttttt

SEQ ID NO: 741031 - DNA, 13 bp, C. elegans
tttccgagaaatt

SEQ ID NO: 741032 - DNA, 13 bp, C. elegans
tttccgagatttc

SEQ ID NO: 741033 - DNA, 13 bp, C. elegans
tttccgagatttt

SEQ ID NO: 741034 - DNA, 13 bp, C. elegans
tttccgaggaaaa

SEQ ID NO: 741035 - DNA, 13 bp, C. elegans
tttccgagtttcg

SEQ ID NO: 741036 - DNA, 13 bp, C. elegans
tttccgagttttt

SEQ ID NO: 741037 - DNA, 13 bp, C. elegans
tttccgataaaaa

SEQ ID NO: 741038 - DNA, 13 bp, C. elegans
tttccgataaaat

SEQ ID NO: 741039 - DNA, 13 bp, C. elegans
tttccgataaatt

SEQ ID NO: 741040 - DNA, 13 bp, C. elegans
tttccgatatttc

SEQ ID NO: 741041 - DNA, 13 bp, C. elegans
tttccgatatttt

SEQ ID NO: 741042 - DNA, 13 bp, C. elegans
tttccgatgaatt

SEQ ID NO: 741043 - DNA, 13 bp, C. elegans
tttccgatgtttt

SEQ ID NO: 741044 - DNA, 13 bp, C. elegans
tttccgattaaaa

SEQ ID NO: 741045 - DNA, 13 bp, C. elegans
tttccgattcaaa

SEQ ID NO: 741046 - DNA, 13 bp, C. elegans
tttccgattgaaa

SEQ ID NO: 741047 - DNA, 13 bp, C. elegans
tttccgatttttg

SEQ ID NO: 741048 - DNA, 13 bp, C. elegans
tttccgcaacttt

SEQ ID NO: 741049 - DNA, 13 bp, C. elegans
tttccgcaatttt

SEQ ID NO: 741050 - DNA, 13 bp, C. elegans
tttccgcatttat

SEQ ID NO: 741051 - DNA, 13 bp, C. elegans
tttccgccatttt

SEQ ID NO: 741052 - DNA, 13 bp, C. elegans
tttccgccgattc

SEQ ID NO: 741053 - DNA, 13 bp, C. elegans
tttccgccgtttt

SEQ ID NO: 741054 - DNA, 13 bp, C. elegans
tttccgcctgttt

SEQ ID NO: 741055 - DNA, 13 bp, C. elegans
tttccgcgaaaat

SEQ ID NO: 741056 - DNA, 13 bp, C. elegans
tttccgcgcggaa

SEQ ID NO: 741057 - DNA, 13 bp, C. elegans
tttccggaaaagt

SEQ ID NO: 741058 - DNA, 13 bp, C. elegans
tttccggaaaatc

SEQ ID NO: 741059 - DNA, 13 bp, C. elegans
tttccggaaattc

SEQ ID NO: 741060 - DNA, 13 bp, C. elegans
tttccggaaattt

SEQ ID NO: 741061 - DNA, 13 bp, C. elegans
tttccggaacttt

SEQ ID NO: 741062 - DNA, 13 bp, C. elegans
tttccggatattt

SEQ ID NO: 741063 - DNA, 13 bp, C. elegans
tttccggcaaaac

SEQ ID NO: 741064 - DNA, 13 bp, C. elegans
tttccggcaaact

SEQ ID NO: 741065 - DNA, 13 bp, C. elegans
tttccggcgaaaa

SEQ ID NO: 741066 - DNA, 13 bp, C. elegans
tttccggtccttt

SEQ ID NO: 741067 - DNA, 13 bp, C. elegans
tttccgtaaatcg

SEQ ID NO: 741068 - DNA, 13 bp, C. elegans
tttccgtactttt

SEQ ID NO: 741069 - DNA, 13 bp, C. elegans
tttccgtagtttt

SEQ ID NO: 741070 - DNA, 13 bp, C. elegans
tttccgtattttc

SEQ ID NO: 741071 - DNA, 13 bp, C. elegans
tttccgtcaaaat

SEQ ID NO: 741072 - DNA, 13 bp, C. elegans
tttccgtcattct

SEQ ID NO: 741073 - DNA, 13 bp, C. elegans
tttccgtctttgg

SEQ ID NO: 741074 - DNA, 13 bp, C. elegans
tttccgtggaaaa

SEQ ID NO: 741075 - DNA, 13 bp, C. elegans
tttccgttaaatt

SEQ ID NO: 741076 - DNA, 13 bp, C. elegans
tttccgttcccat

SEQ ID NO: 741077 - DNA, 13 bp, C. elegans
tttccgtttcaaa

SEQ ID NO: 741078 - DNA, 13 bp, C. elegans
tttccgtttcaat

SEQ ID NO: 741079 - DNA, 13 bp, C. elegans
tttccgtttctca

SEQ ID NO: 741080 - DNA, 13 bp, C. elegans
tttccgttttccg

SEQ ID NO: 741081 - DNA, 13 bp, C. elegans
tttcctaaaatta

SEQ ID NO: 741082 - DNA, 13 bp, C. elegans
tttcctaataatt

SEQ ID NO: 741083 - DNA, 13 bp, C. elegans
tttcctaatgaaa

SEQ ID NO: 741084 - DNA, 13 bp, C. elegans
tttcctaatttcc

SEQ ID NO: 741085 - DNA, 13 bp, C. elegans
tttcctacaaaaa

SEQ ID NO: 741086 - DNA, 13 bp, C. elegans
tttcctacatttc

SEQ ID NO: 741087 - DNA, 13 bp, C. elegans
tttcctaccaaaa

SEQ ID NO: 741088 - DNA, 13 bp, C. elegans
tttcctacgtttt

SEQ ID NO: 741089 - DNA, 13 bp, C. elegans
tttcctagaaaaa

SEQ ID NO: 741090 - DNA, 13 bp, C. elegans
tttcctagatttt

SEQ ID NO: 741091 - DNA, 13 bp, C. elegans
tttcctagttttc

SEQ ID NO: 741092 - DNA, 13 bp, C. elegans
tttcctataactt

SEQ ID NO: 741093 - DNA, 13 bp, C. elegans
tttcctatcaaaa

SEQ ID NO: 741094 - DNA, 13 bp, C. elegans
tttcctattgaaa

SEQ ID NO: 741095 - DNA, 13 bp, C. elegans
tttcctatttgcc

SEQ ID NO: 741096 - DNA, 13 bp, C. elegans
tttcctcaaaatc

SEQ ID NO: 741097 - DNA, 13 bp, C. elegans
tttcctcaaattc

SEQ ID NO: 741098 - DNA, 13 bp, C. elegans
tttcctcaacttt

SEQ ID NO: 741099 - DNA, 13 bp, C. elegans
tttcctcaatttc

SEQ ID NO: 741100 - DNA, 13 bp, C. elegans
tttcctcacattt

SEQ ID NO: 741101 - DNA, 13 bp, C. elegans
tttcctcattgaa

SEQ ID NO: 741102 - DNA, 13 bp, C. elegans
tttcctccaaaac

SEQ ID NO: 741103 - DNA, 13 bp, C. elegans
tttcctcgaattt

SEQ ID NO: 741104 - DNA, 13 bp, C. elegans
tttcctctaaaaa

SEQ ID NO: 741105 - DNA, 13 bp, C. elegans
tttcctctaatgt

SEQ ID NO: 741106 - DNA, 13 bp, C. elegans
tttcctctgaaaa

SEQ ID NO: 741107 - DNA, 13 bp, C. elegans
tttcctgaaaagt

SEQ ID NO: 741108 - DNA, 13 bp, C. elegans
tttcctgaaaatc

SEQ ID NO: 741109 - DNA, 13 bp, C. elegans
tttcctgaaaatg

SEQ ID NO: 741110 - DNA, 13 bp, C. elegans
tttcctgaaattt

SEQ ID NO: 741111 - DNA, 13 bp, C. elegans
tttcctgaatatt

SEQ ID NO: 741112 - DNA, 13 bp, C. elegans
tttcctgcaaatc

SEQ ID NO: 741113 - DNA, 13 bp, C. elegans
tttcctgccaaaa

SEQ ID NO: 741114 - DNA, 13 bp, C. elegans
tttcctgcgaaaa

SEQ ID NO: 741115 - DNA, 13 bp, C. elegans
tttcctgctgaaa

SEQ ID NO: 741116 - DNA, 13 bp, C. elegans
tttcctggatttt

SEQ ID NO: 741117 - DNA, 13 bp, C. elegans
tttcctgtaaaat

SEQ ID NO: 741118 - DNA, 13 bp, C. elegans
tttcctgtaaatc

SEQ ID NO: 741119 - DNA, 13 bp, C. elegans
tttcctgtcattt

SEQ ID NO: 741120 - DNA, 13 bp, C. elegans
tttcctgtgaaaa

SEQ ID NO: 741121 - DNA, 13 bp, C. elegans
tttcctgttgatt

SEQ ID NO: 741122 - DNA, 13 bp, C. elegans
tttcctgtttcaa

SEQ ID NO: 741123 - DNA, 13 bp, C. elegans
tttcctgtttgaa

SEQ ID NO: 741124 - DNA, 13 bp, C. elegans
tttcctgttttca

SEQ ID NO: 741125 - DNA, 13 bp, C. elegans
tttccttaaaata

SEQ ID NO: 741126 - DNA, 13 bp, C. elegans
tttccttatcaaa

SEQ ID NO: 741127 - DNA, 13 bp, C. elegans
tttccttcaaaaa

SEQ ID NO: 741128 - DNA, 13 bp, C. elegans
tttccttcaaaat

SEQ ID NO: 741129 - DNA, 13 bp, C. elegans
tttccttcaaatt

SEQ ID NO: 741130 - DNA, 13 bp, C. elegans
tttccttcaatta

SEQ ID NO: 741131 - DNA, 13 bp, C. elegans
tttccttccaatt

SEQ ID NO: 741132 - DNA, 13 bp, C. elegans
tttccttctaaaa

SEQ ID NO: 741133 - DNA, 13 bp, C. elegans
tttccttctgaaa

SEQ ID NO: 741134 - DNA, 13 bp, C. elegans
tttccttgaaaaa

SEQ ID NO: 741135 - DNA, 13 bp, C. elegans
tttccttgttcaa

SEQ ID NO: 741136 - DNA, 13 bp, C. elegans
tttcctttcaaaa

SEQ ID NO: 741137 - DNA, 13 bp, C. elegans
tttccttttgaaa

SEQ ID NO: 741138 - DNA, 13 bp, C. elegans
tttccttttggaa

SEQ ID NO: 741139 - DNA, 13 bp, C. elegans
tttcctttttcga

SEQ ID NO: 741140 - DNA, 13 bp, C. elegans
tttcgaaaaaaaa

SEQ ID NO: 741141 - DNA, 13 bp, C. elegans
tttcgaaaaaaca

SEQ ID NO: 741142 - DNA, 13 bp, C. elegans
tttcgaaaaaata

SEQ ID NO: 741143 - DNA, 13 bp, C. elegans
tttcgaaaaaatc

SEQ ID NO: 741144 - DNA, 13 bp, C. elegans
tttcgaaaaacta

SEQ ID NO: 741145 - DNA, 13 bp, C. elegans
tttcgaaaaagtg

SEQ ID NO: 741146 - DNA, 13 bp, C. elegans
tttcgaaaaataa

SEQ ID NO: 741147 - DNA, 13 bp, C. elegans
tttcgaaaaatca

SEQ ID NO: 741148 - DNA, 14 bp, C. elegans
tttcgaaaaatgga

SEQ ID NO: 741149 - DNA, 13 bp, C. elegans
tttcgaaaaattc

SEQ ID NO: 741150 - DNA, 13 bp, C. elegans
tttcgaaaaattg

SEQ ID NO: 741151 - DNA, 13 bp, C. elegans
tttcgaaaaattt

SEQ ID NO: 741152 - DNA, 13 bp, C. elegans
tttcgaaaacaat

SEQ ID NO: 741153 - DNA, 13 bp, C. elegans
tttcgaaaactaa

SEQ ID NO: 741154 - DNA, 13 bp, C. elegans
tttcgaaaactca

SEQ ID NO: 741155 - DNA, 13 bp, C. elegans
tttcgaaaacttt

SEQ ID NO: 741156 - DNA, 13 bp, C. elegans
tttcgaaaagttt

SEQ ID NO: 741157 - DNA, 13 bp, C. elegans
tttcgaaaatcaa

SEQ ID NO: 741158 - DNA, 13 bp, C. elegans
tttcgaaaatcat

SEQ ID NO: 741159 - DNA, 13 bp, C. elegans
tttcgaaaatcga

SEQ ID NO: 741160 - DNA, 13 bp, C. elegans
tttcgaaaatcta

SEQ ID NO: 741161 - DNA, 13 bp, C. elegans
tttcgaaaatctt

SEQ ID NO: 741162 - DNA, 13 bp, C. elegans
tttcgaaaatgaa

SEQ ID NO: 741163 - DNA, 13 bp, C. elegans
tttcgaaaatgtt

SEQ ID NO: 741164 - DNA, 13 bp, C. elegans
tttcgaaaattct

SEQ ID NO: 741165 - DNA, 13 bp, C. elegans
tttcgaaaatttc

SEQ ID NO: 741166 - DNA, 13 bp, C. elegans
tttcgaaacattt

SEQ ID NO: 741167 - DNA, 13 bp, C. elegans
tttcgaaacgaaa

SEQ ID NO: 741168 - DNA, 13 bp, C. elegans
tttcgaaactttc

SEQ ID NO: 741169 - DNA, 13 bp, C. elegans
tttcgaaagcttt

SEQ ID NO: 741170 - DNA, 13 bp, C. elegans
tttcgaaagttaa

SEQ ID NO: 741171 - DNA, 13 bp, C. elegans
tttcgaaagttat

SEQ ID NO: 741172 - DNA, 13 bp, C. elegans
tttcgaaataaaa

SEQ ID NO: 741173 - DNA, 13 bp, C. elegans
tttcgaaataact

SEQ ID NO: 741174 - DNA, 13 bp, C. elegans
tttcgaaatatcg

SEQ ID NO: 741175 - DNA, 13 bp, C. elegans
tttcgaaatattt

SEQ ID NO: 741176 - DNA, 13 bp, C. elegans
tttcgaaattatt

SEQ ID NO: 741177 - DNA, 13 bp, C. elegans
tttcgaaattcat

SEQ ID NO: 741178 - DNA, 13 bp, C. elegans
tttcgaaattctc

SEQ ID NO: 741179 - DNA, 13 bp, C. elegans
tttcgaaattctt

SEQ ID NO: 741180 - DNA, 13 bp, C. elegans
tttcgaaatttca

SEQ ID NO: 741181 - DNA, 13 bp, C. elegans
tttcgaaattttg

SEQ ID NO: 741182 - DNA, 13 bp, C. elegans
tttcgaacaaaat

SEQ ID NO: 741183 - DNA, 13 bp, C. elegans
tttcgaacaaatt

SEQ ID NO: 741184 - DNA, 13 bp, C. elegans
tttcgaacagttt

SEQ ID NO: 741185 - DNA, 13 bp, C. elegans
tttcgaacatttt

SEQ ID NO: 741186 - DNA, 13 bp, C. elegans
tttcgaaccaaaa

SEQ ID NO: 741187 - DNA, 13 bp, C. elegans
tttcgaacgaaaa

SEQ ID NO: 741188 - DNA, 13 bp, C. elegans
tttcgaagaaaac

SEQ ID NO: 741189 - DNA, 13 bp, C. elegans
tttcgaagaaatt

SEQ ID NO: 741190 - DNA, 13 bp, C. elegans
tttcgaagatcca

SEQ ID NO: 741191 - DNA, 13 bp, C. elegans
tttcgaagattaa

SEQ ID NO: 741192 - DNA, 13 bp, C. elegans
tttcgaaggaaaa

SEQ ID NO: 741193 - DNA, 13 bp, C. elegans
tttcgaataaaaa

SEQ ID NO: 741194 - DNA, 13 bp, C. elegans
tttcgaataaaat

SEQ ID NO: 741195 - DNA, 13 bp, C. elegans
tttcgaataataa

SEQ ID NO: 741196 - DNA, 13 bp, C. elegans
tttcgaataattt

SEQ ID NO: 741197 - DNA, 13 bp, C. elegans
tttcgaatagaaa

SEQ ID NO: 741198 - DNA, 13 bp, C. elegans
tttcgaatatatt

SEQ ID NO: 741199 - DNA, 13 bp, C. elegans
tttcgaatcattt

SEQ ID NO: 741200 - DNA, 13 bp, C. elegans
tttcgaatgtttt

SEQ ID NO: 741201 - DNA, 13 bp, C. elegans
tttcgaattctca

SEQ ID NO: 741202 - DNA, 13 bp, C. elegans
tttcgaatttaag

SEQ ID NO: 741203 - DNA, 13 bp, C. elegans
tttcgaatttcca

SEQ ID NO: 741204 - DNA, 13 bp, C. elegans
tttcgaatttgga

SEQ ID NO: 741205 - DNA, 13 bp, C. elegans
tttcgaatttgtt

SEQ ID NO: 741206 - DNA, 13 bp, C. elegans
tttcgaattttaa

SEQ ID NO: 741207 - DNA, 13 bp, C. elegans
tttcgaattttcc

SEQ ID NO: 741208 - DNA, 13 bp, C. elegans
tttcgaattttcg

SEQ ID NO: 741209 - DNA, 13 bp, C. elegans
tttcgaattttta

SEQ ID NO: 741210 - DNA, 13 bp, C. elegans
tttcgaatttttg

SEQ ID NO: 741211 - DNA, 13 bp, C. elegans
tttcgacaaaata

SEQ ID NO: 741212 - DNA, 13 bp, C. elegans
tttcgacaaaatc

SEQ ID NO: 741213 - DNA, 13 bp, C. elegans
tttcgacaaattt

SEQ ID NO: 741214 - DNA, 13 bp, C. elegans
tttcgacaatttt

SEQ ID NO: 741215 - DNA, 13 bp, C. elegans
tttcgacactttt

SEQ ID NO: 741216 - DNA, 13 bp, C. elegans
tttcgacagtttt

SEQ ID NO: 741217 - DNA, 13 bp, C. elegans
tttcgaccaaaaa

SEQ ID NO: 741218 - DNA, 13 bp, C. elegans
tttcgacctaaaa

SEQ ID NO: 741219 - DNA, 13 bp, C. elegans
tttcgacgaaaaa

SEQ ID NO: 741220 - DNA, 14 bp, C. elegans
tttcgacgaaaaaa

SEQ ID NO: 741221 - DNA, 13 bp, C. elegans
tttcgacgaattt

SEQ ID NO: 741222 - DNA, 13 bp, C. elegans
tttcgacgatttt

SEQ ID NO: 741223 - DNA, 13 bp, C. elegans
tttcgacgtaaaa

SEQ ID NO: 741224 - DNA, 13 bp, C. elegans
tttcgactatttc

SEQ ID NO: 741225 - DNA, 13 bp, C. elegans
tttcgactatttt

SEQ ID NO: 741226 - DNA, 13 bp, C. elegans
tttcgactgaaaa

SEQ ID NO: 741227 - DNA, 13 bp, C. elegans
tttcgactggaaa

SEQ ID NO: 741228 - DNA, 13 bp, C. elegans
tttcgactgtttt

SEQ ID NO: 741229 - DNA, 13 bp, C. elegans
tttcgacttttct

SEQ ID NO: 741230 - DNA, 13 bp, C. elegans
tttcgacttttta

SEQ ID NO: 741231 - DNA, 13 bp, C. elegans
tttcgagaaaaaa

SEQ ID NO: 741232 - DNA, 13 bp, C. elegans
tttcgagaaaatg

SEQ ID NO: 741233 - DNA, 13 bp, C. elegans
tttcgagaaacat

SEQ ID NO: 741234 - DNA, 13 bp, C. elegans
tttcgagaaactt

SEQ ID NO: 741235 - DNA, 13 bp, C. elegans
tttcgagaaagtt

SEQ ID NO: 741236 - DNA, 13 bp, C. elegans
tttcgagaaatat

SEQ ID NO: 741237 - DNA, 13 bp, C. elegans
tttcgagaaattt

SEQ ID NO: 741238 - DNA, 13 bp, C. elegans
tttcgagaacaat

SEQ ID NO: 741239 - DNA, 13 bp, C. elegans
tttcgagaataat

SEQ ID NO: 741240 - DNA, 13 bp, C. elegans
tttcgagaatttg

SEQ ID NO: 741241 - DNA, 13 bp, C. elegans
tttcgagactttt

SEQ ID NO: 741242 - DNA, 13 bp, C. elegans
tttcgagagtttt

SEQ ID NO: 741243 - DNA, 13 bp, C. elegans
tttcgagatcaaa

SEQ ID NO: 741244 - DNA, 13 bp, C. elegans
tttcgagattttc

SEQ ID NO: 741245 - DNA, 13 bp, C. elegans
tttcgagattttt

SEQ ID NO: 741246 - DNA, 13 bp, C. elegans
tttcgagcaaaat

SEQ ID NO: 741247 - DNA, 13 bp, C. elegans
tttcgagcaattt

SEQ ID NO: 741248 - DNA, 13 bp, C. elegans
tttcgagcttttc

SEQ ID NO: 741249 - DNA, 13 bp, C. elegans
tttcgaggatttt

SEQ ID NO: 741250 - DNA, 13 bp, C. elegans
tttcgaggcaaaa

SEQ ID NO: 741251 - DNA, 13 bp, C. elegans
tttcgagggaaaa

SEQ ID NO: 741252 - DNA, 13 bp, C. elegans
tttcgaggttttc

SEQ ID NO: 741253 - DNA, 13 bp, C. elegans
tttcgagtaaatt

SEQ ID NO: 741254 - DNA, 13 bp, C. elegans
tttcgagtgtttt

SEQ ID NO: 741255 - DNA, 13 bp, C. elegans
tttcgagttgaaa

SEQ ID NO: 741256 - DNA, 13 bp, C. elegans
tttcgagttttaa

SEQ ID NO: 741257 - DNA, 13 bp, C. elegans
tttcgagtttttc

SEQ ID NO: 741258 - DNA, 13 bp, C. elegans
tttcgataaaaaa

SEQ ID NO: 741259 - DNA, 13 bp, C. elegans
tttcgataatttt

SEQ ID NO: 741260 - DNA, 13 bp, C. elegans
tttcgatactttt

SEQ ID NO: 741261 - DNA, 13 bp, C. elegans
tttcgatagtttt

SEQ ID NO: 741262 - DNA, 13 bp, C. elegans
tttcgatatcttt

SEQ ID NO: 741263 - DNA, 13 bp, C. elegans
tttcgatcaaaaa

SEQ ID NO: 741264 - DNA, 13 bp, C. elegans
tttcgatcaattt

SEQ ID NO: 741265 - DNA, 13 bp, C. elegans
tttcgatcttttc

SEQ ID NO: 741266 - DNA, 13 bp, C. elegans
tttcgatcttttg

SEQ ID NO: 741267 - DNA, 13 bp, C. elegans
tttcgatgaaata

SEQ ID NO: 741268 - DNA, 13 bp, C. elegans
tttcgatgaaatt

SEQ ID NO: 741269 - DNA, 13 bp, C. elegans
tttcgatgaattt

SEQ ID NO: 741270 - DNA, 13 bp, C. elegans
tttcgatgatttc

SEQ ID NO: 741271 - DNA, 13 bp, C. elegans
tttcgatgctctt

SEQ ID NO: 741272 - DNA, 13 bp, C. elegans
tttcgatggaaaa

SEQ ID NO: 741273 - DNA, 13 bp, C. elegans
tttcgattaattt

SEQ ID NO: 741274 - DNA, 13 bp, C. elegans
tttcgattataat

SEQ ID NO: 741275 - DNA, 13 bp, C. elegans
tttcgattcaatc

SEQ ID NO: 741276 - DNA, 13 bp, C. elegans
tttcgattccctt

SEQ ID NO: 741277 - DNA, 13 bp, C. elegans
tttcgattgaaaa

SEQ ID NO: 741278 - DNA, 13 bp, C. elegans
tttcgattgaata

SEQ ID NO: 741279 - DNA, 13 bp, C. elegans
tttcgattgtatt

SEQ ID NO: 741280 - DNA, 13 bp, C. elegans
tttcgatttaaaa

SEQ ID NO: 741281 - DNA, 32 bp, C. elegans
tttcgatttacaggagccgagatattaagctt

SEQ ID NO: 741282 - DNA, 13 bp, C. elegans
tttcgatttatat

SEQ ID NO: 741283 - DNA, 13 bp, C. elegans
tttcgatttattg

SEQ ID NO: 741284 - DNA, 13 bp, C. elegans
tttcgatttcaaa

SEQ ID NO: 741285 - DNA, 13 bp, C. elegans
tttcgatttcatt

SEQ ID NO: 741286 - DNA, 13 bp, C. elegans
tttcgatttctta

SEQ ID NO: 741287 - DNA, 13 bp, C. elegans
tttcgatttgaat

SEQ ID NO: 741288 - DNA, 13 bp, C. elegans
tttcgattttagt

SEQ ID NO: 741289 - DNA, 13 bp, C. elegans
tttcgattttcac

SEQ ID NO: 741290 - DNA, 13 bp, C. elegans
tttcgattttcag

SEQ ID NO: 741291 - DNA, 13 bp, C. elegans
tttcgattttctg

SEQ ID NO: 741292 - DNA, 13 bp, C. elegans
tttcgattttgaa

SEQ ID NO: 741293 - DNA, 13 bp, C. elegans
tttcgatttttaa

SEQ ID NO: 741294 - DNA, 13 bp, C. elegans
tttcgatttttca

SEQ ID NO: 741295 - DNA, 13 bp, C. elegans
tttcgatttttcg

SEQ ID NO: 741296 - DNA, 13 bp, C. elegans
tttcgatttttgc

SEQ ID NO: 741297 - DNA, 13 bp, C. elegans
tttcgcaacaaaa

SEQ ID NO: 741298 - DNA, 13 bp, C. elegans
tttcgcaacactg

SEQ ID NO: 741299 - DNA, 13 bp, C. elegans
tttcgcaacattt

SEQ ID NO: 741300 - DNA, 13 bp, C. elegans
tttcgcaacgaga

SEQ ID NO: 741301 - DNA, 13 bp, C. elegans
tttcgcaactttt

SEQ ID NO: 741302 - DNA, 13 bp, C. elegans
tttcgcaattttt

SEQ ID NO: 741303 - DNA, 13 bp, C. elegans
tttcgcacaaaaa

SEQ ID NO: 741304 - DNA, 13 bp, C. elegans
tttcgcacaattt

SEQ ID NO: 741305 - DNA, 13 bp, C. elegans
tttcgcactattt

SEQ ID NO: 741306 - DNA, 13 bp, C. elegans
tttcgcacttatt

SEQ ID NO: 741307 - DNA, 13 bp, C. elegans
tttcgcatttatt

SEQ ID NO: 741308 - DNA, 13 bp, C. elegans
tttcgcattttat

SEQ ID NO: 741309 - DNA, 13 bp, C. elegans
tttcgcattttcg

SEQ ID NO: 741310 - DNA, 13 bp, C. elegans
tttcgcatttttc

SEQ ID NO: 741311 - DNA, 13 bp, C. elegans
tttcgccaatttt

SEQ ID NO: 741312 - DNA, 13 bp, C. elegans
tttcgcccaaaaa

SEQ ID NO: 741313 - DNA, 13 bp, C. elegans
tttcgccgaattc

SEQ ID NO: 741314 - DNA, 13 bp, C. elegans
tttcgccgatttt

SEQ ID NO: 741315 - DNA, 13 bp, C. elegans
tttcgcctatttt

SEQ ID NO: 741316 - DNA, 13 bp, C. elegans
tttcgcgattttt

SEQ ID NO: 741317 - DNA, 13 bp, C. elegans
tttcgcgcaaaat

SEQ ID NO: 741318 - DNA, 13 bp, C. elegans
tttcgcgccaatt

SEQ ID NO: 741319 - DNA, 13 bp, C. elegans
tttcgcgctaaaa

SEQ ID NO: 741320 - DNA, 13 bp, C. elegans
tttcgctagtttt

SEQ ID NO: 741321 - DNA, 13 bp, C. elegans
tttcgctattttc

SEQ ID NO: 741322 - DNA, 13 bp, C. elegans
tttcgctcagaaa

SEQ ID NO: 741323 - DNA, 13 bp, C. elegans
tttcgctgaaaaa

SEQ ID NO: 741324 - DNA, 25 bp, C. elegans
tttcgctgctcactaggaaacgaac

SEQ ID NO: 741325 - DNA, 13 bp, C. elegans
tttcgctggaaaa

SEQ ID NO: 741326 - DNA, 13 bp, C. elegans
tttcgcttcaaaa

SEQ ID NO: 741327 - DNA, 13 bp, C. elegans
tttcgcttgtctc

SEQ ID NO: 741328 - DNA, 13 bp, C. elegans
tttcgctttaaaa

SEQ ID NO: 741329 - DNA, 13 bp, C. elegans
tttcgctttcaaa

SEQ ID NO: 741330 - DNA, 13 bp, C. elegans
tttcgcttttcaa

SEQ ID NO: 741331 - DNA, 13 bp, C. elegans
tttcgctttttga

SEQ ID NO: 741332 - DNA, 13 bp, C. elegans
tttcggaaaaacc

SEQ ID NO: 741333 - DNA, 13 bp, C. elegans
tttcggaaaaacg

SEQ ID NO: 741334 - DNA, 13 bp, C. elegans
tttcggaaaaagt

SEQ ID NO: 741335 - DNA, 13 bp, C. elegans
tttcggaaaacgt

SEQ ID NO: 741336 - DNA, 13 bp, C. elegans
tttcggaaaatca

SEQ ID NO: 741337 - DNA, 13 bp, C. elegans
tttcggaaaatcc

SEQ ID NO: 741338 - DNA, 13 bp, C. elegans
tttcggaaaatcg

SEQ ID NO: 741339 - DNA, 13 bp, C. elegans
tttcggaaaatga

SEQ ID NO: 741340 - DNA, 13 bp, C. elegans
tttcggaaaattc

SEQ ID NO: 741341 - DNA, 13 bp, C. elegans
tttcggaaaattt

SEQ ID NO: 741342 - DNA, 13 bp, C. elegans
tttcggaaagttt

SEQ ID NO: 741343 - DNA, 13 bp, C. elegans
tttcggaaatctt

SEQ ID NO: 741344 - DNA, 13 bp, C. elegans
tttcggaaattta

SEQ ID NO: 741345 - DNA, 13 bp, C. elegans
tttcggaaatttc

SEQ ID NO: 741346 - DNA, 13 bp, C. elegans
tttcggaacattt

SEQ ID NO: 741347 - DNA, 13 bp, C. elegans
tttcggaataaaa

SEQ ID NO: 741348 - DNA, 13 bp, C. elegans
tttcggaatcttg

SEQ ID NO: 741349 - DNA, 13 bp, C. elegans
tttcggaatgttt

SEQ ID NO: 741350 - DNA, 13 bp, C. elegans
tttcggaatttga

SEQ ID NO: 741351 - DNA, 13 bp, C. elegans
tttcggaattttt

SEQ ID NO: 741352 - DNA, 13 bp, C. elegans
tttcggaccaaaa

SEQ ID NO: 741353 - DNA, 13 bp, C. elegans
tttcggagaaaaa

SEQ ID NO: 741354 - DNA, 13 bp, C. elegans
tttcggagttttt

SEQ ID NO: 741355 - DNA, 13 bp, C. elegans
tttcggataattt

SEQ ID NO: 741356 - DNA, 13 bp, C. elegans
tttcggatgaaaa

SEQ ID NO: 741357 - DNA, 13 bp, C. elegans
tttcggatttcaa

SEQ ID NO: 741358 - DNA, 13 bp, C. elegans
tttcggcaaattg

SEQ ID NO: 741359 - DNA, 13 bp, C. elegans
tttcggcaaattt

SEQ ID NO: 741360 - DNA, 13 bp, C. elegans
tttcggcaactgc

SEQ ID NO: 741361 - DNA, 13 bp, C. elegans
tttcggcaattgt

SEQ ID NO: 741362 - DNA, 13 bp, C. elegans
tttcggcactttc

SEQ ID NO: 741363 - DNA, 13 bp, C. elegans
tttcggcagttgc

SEQ ID NO: 741364 - DNA, 13 bp, C. elegans
tttcggcattttt

SEQ ID NO: 741365 - DNA, 13 bp, C. elegans
tttcggccgtttt

SEQ ID NO: 741366 - DNA, 13 bp, C. elegans
tttcggcctaaaa

SEQ ID NO: 741367 - DNA, 14 bp, C. elegans
tttcggcggaaaaa

SEQ ID NO: 741368 - DNA, 13 bp, C. elegans
tttcggcggtttt

SEQ ID NO: 741369 - DNA, 13 bp, C. elegans
tttcgggaaaaac

SEQ ID NO: 741370 - DNA, 13 bp, C. elegans
tttcgggaaattt

SEQ ID NO: 741371 - DNA, 13 bp, C. elegans
tttcgggagaaaa

SEQ ID NO: 741372 - DNA, 13 bp, C. elegans
tttcgggcaattt

SEQ ID NO: 741373 - DNA, 13 bp, C. elegans
tttcgggtatttt

SEQ ID NO: 741374 - DNA, 13 bp, C. elegans
tttcggtactcca

SEQ ID NO: 741375 - DNA, 13 bp, C. elegans
tttcggtgaaaat

SEQ ID NO: 741376 - DNA, 13 bp, C. elegans
tttcggtgatttt

SEQ ID NO: 741377 - DNA, 13 bp, C. elegans
tttcggttttcac

SEQ ID NO: 741378 - DNA, 13 bp, C. elegans
tttcggttttcag

SEQ ID NO: 741379 - DNA, 13 bp, C. elegans
tttcggttttcat

SEQ ID NO: 741380 - DNA, 13 bp, C. elegans
tttcggttttcca

SEQ ID NO: 741381 - DNA, 13 bp, C. elegans
tttcgtaaaaatt

SEQ ID NO: 741382 - DNA, 13 bp, C. elegans
tttcgtaaaatat

SEQ ID NO: 741383 - DNA, 13 bp, C. elegans
tttcgtaaaatct

SEQ ID NO: 741384 - DNA, 13 bp, C. elegans
tttcgtaaagttt

SEQ ID NO: 741385 - DNA, 13 bp, C. elegans
tttcgtaatattt

SEQ ID NO: 741386 - DNA, 13 bp, C. elegans
tttcgtaatgaga

SEQ ID NO: 741387 - DNA, 13 bp, C. elegans
tttcgtagaattt

SEQ ID NO: 741388 - DNA, 13 bp, C. elegans
tttcgtagatcat

SEQ ID NO: 741389 - DNA, 13 bp, C. elegans
tttcgtagtttgt

SEQ ID NO: 741390 - DNA, 13 bp, C. elegans
tttcgtatcaata

SEQ ID NO: 741391 - DNA, 13 bp, C. elegans
tttcgtatggtta

SEQ ID NO: 741392 - DNA, 13 bp, C. elegans
tttcgtatttcaa

SEQ ID NO: 741393 - DNA, 13 bp, C. elegans
tttcgtatttctg

SEQ ID NO: 741394 - DNA, 13 bp, C. elegans
tttcgtattttca

SEQ ID NO: 741395 - DNA, 13 bp, C. elegans
tttcgtcaaaaaa

SEQ ID NO: 741396 - DNA, 13 bp, C. elegans
tttcgtcaaactt

SEQ ID NO: 741397 - DNA, 13 bp, C. elegans
tttcgtcaatttt

SEQ ID NO: 741398 - DNA, 13 bp, C. elegans
tttcgtcactttt

SEQ ID NO: 741399 - DNA, 13 bp, C. elegans
tttcgtcagaaaa

SEQ ID NO: 741400 - DNA, 13 bp, C. elegans
tttcgtcatattt

SEQ ID NO: 741401 - DNA, 13 bp, C. elegans
tttcgtccatttt

SEQ ID NO: 741402 - DNA, 13 bp, C. elegans
tttcgtcccaaaa

SEQ ID NO: 741403 - DNA, 13 bp, C. elegans
tttcgtcgaaaaa

SEQ ID NO: 741404 - DNA, 13 bp, C. elegans
tttcgtctcaaaa

SEQ ID NO: 741405 - DNA, 13 bp, C. elegans
tttcgtctttatc

SEQ ID NO: 741406 - DNA, 13 bp, C. elegans
tttcgtgaacttt

SEQ ID NO: 741407 - DNA, 13 bp, C. elegans
tttcgtgaatttt

SEQ ID NO: 741408 - DNA, 13 bp, C. elegans
tttcgtgacattt

SEQ ID NO: 741409 - DNA, 13 bp, C. elegans
tttcgtgactttt

SEQ ID NO: 741410 - DNA, 13 bp, C. elegans
tttcgtgataatt

SEQ ID NO: 741411 - DNA, 13 bp, C. elegans
tttcgtgtaattt

SEQ ID NO: 741412 - DNA, 13 bp, C. elegans
tttcgtgtcaaga

SEQ ID NO: 741413 - DNA, 13 bp, C. elegans
tttcgttaaaaaa

SEQ ID NO: 741414 - DNA, 13 bp, C. elegans
tttcgttaaaatt

SEQ ID NO: 741415 - DNA, 13 bp, C. elegans
tttcgttaacttt

SEQ ID NO: 741416 - DNA, 13 bp, C. elegans
tttcgttacgaaa

SEQ ID NO: 741417 - DNA, 13 bp, C. elegans
tttcgttagaaaa

SEQ ID NO: 741418 - DNA, 13 bp, C. elegans
tttcgttcaaaaa

SEQ ID NO: 741419 - DNA, 13 bp, C. elegans
tttcgttccaaaa

SEQ ID NO: 741420 - DNA, 13 bp, C. elegans
tttcgttccattt

SEQ ID NO: 741421 - DNA, 13 bp, C. elegans
tttcgttcgaaaa

SEQ ID NO: 741422 - DNA, 13 bp, C. elegans
tttcgttcgattt

SEQ ID NO: 741423 - DNA, 13 bp, C. elegans
tttcgttctgctc

SEQ ID NO: 741424 - DNA, 13 bp, C. elegans
tttcgttgaaaaa

SEQ ID NO: 741425 - DNA, 13 bp, C. elegans
tttcgtttaaaaa

SEQ ID NO: 741426 - DNA, 13 bp, C. elegans
tttcgtttgaaat

SEQ ID NO: 741427 - DNA, 13 bp, C. elegans
tttcgttttacaa

SEQ ID NO: 741428 - DNA, 13 bp, C. elegans
tttcgttttcaca

SEQ ID NO: 741429 - DNA, 13 bp, C. elegans
tttcgttttctag

SEQ ID NO: 741430 - DNA, 13 bp, C. elegans
tttcgtttttcga

SEQ ID NO: 741431 - DNA, 13 bp, C. elegans
tttcgtttttgaa

SEQ ID NO: 741432 - DNA, 13 bp, C. elegans
tttcgtttttgag

SEQ ID NO: 741433 - DNA, 13 bp, C. elegans
tttctaaaaatct

SEQ ID NO: 741434 - DNA, 13 bp, C. elegans
tttctaaaacctt

SEQ ID NO: 741435 - DNA, 13 bp, C. elegans
tttctaaaacttt

SEQ ID NO: 741436 - DNA, 13 bp, C. elegans
tttctaaaagaat

SEQ ID NO: 741437 - DNA, 13 bp, C. elegans
tttctaaaagtga

SEQ ID NO: 741438 - DNA, 13 bp, C. elegans
tttctaaaagttc

SEQ ID NO: 741439 - DNA, 13 bp, C. elegans
tttctaaaataca

SEQ ID NO: 741440 - DNA, 13 bp, C. elegans
tttctaaaatgta

SEQ ID NO: 741441 - DNA, 13 bp, C. elegans
tttctaaaatttc

SEQ ID NO: 741442 - DNA, 13 bp, C. elegans
tttctaaacactt

SEQ ID NO: 741443 - DNA, 13 bp, C. elegans
tttctaaacattt

SEQ ID NO: 741444 - DNA, 13 bp, C. elegans
tttctaaacttcc

SEQ ID NO: 741445 - DNA, 13 bp, C. elegans
tttctaaagttca

SEQ ID NO: 741446 - DNA, 13 bp, C. elegans
tttctaaagtttt

SEQ ID NO: 741447 - DNA, 13 bp, C. elegans
tttctaaatctaa

SEQ ID NO: 741448 - DNA, 13 bp, C. elegans
tttctaaattcaa

SEQ ID NO: 741449 - DNA, 13 bp, C. elegans
tttctaaattgaa

SEQ ID NO: 741450 - DNA, 13 bp, C. elegans
tttctaaatttca

SEQ ID NO: 741451 - DNA, 13 bp, C. elegans
tttctaaatttcc

SEQ ID NO: 741452 - DNA, 13 bp, C. elegans
tttctaacaaaat

SEQ ID NO: 741453 - DNA, 13 bp, C. elegans
tttctaacaactt

SEQ ID NO: 741454 - DNA, 13 bp, C. elegans
tttctaacaagtt

SEQ ID NO: 741455 - DNA, 13 bp, C. elegans
tttctaaccattt

SEQ ID NO: 741456 - DNA, 13 bp, C. elegans
tttctaactttaa

SEQ ID NO: 741457 - DNA, 13 bp, C. elegans
tttctaagaattt

SEQ ID NO: 741458 - DNA, 13 bp, C. elegans
tttctaataaaac

SEQ ID NO: 741459 - DNA, 13 bp, C. elegans
tttctaatagaaa

SEQ ID NO: 741460 - DNA, 13 bp, C. elegans
tttctaatcaatt

SEQ ID NO: 741461 - DNA, 13 bp, C. elegans
tttctaatgaaaa

SEQ ID NO: 741462 - DNA, 13 bp, C. elegans
tttctaatgattt

SEQ ID NO: 741463 - DNA, 13 bp, C. elegans
tttctaattctaa

SEQ ID NO: 741464 - DNA, 13 bp, C. elegans
tttctaattgaaa

SEQ ID NO: 741465 - DNA, 13 bp, C. elegans
tttctaattgatt

SEQ ID NO: 741466 - DNA, 13 bp, C. elegans
tttctaattgtaa

SEQ ID NO: 741467 - DNA, 13 bp, C. elegans
tttctaatttcaa

SEQ ID NO: 741468 - DNA, 13 bp, C. elegans
tttctaatttccc

SEQ ID NO: 741469 - DNA, 13 bp, C. elegans
tttctaatttgaa

SEQ ID NO: 741470 - DNA, 13 bp, C. elegans
tttctaatttgca

SEQ ID NO: 741471 - DNA, 13 bp, C. elegans
tttctaatttgga

SEQ ID NO: 741472 - DNA, 13 bp, C. elegans
tttctacaaaaaa

SEQ ID NO: 741473 - DNA, 13 bp, C. elegans
tttctacaaaaat

SEQ ID NO: 741474 - DNA, 13 bp, C. elegans
tttctacaaaaca

SEQ ID NO: 741475 - DNA, 13 bp, C. elegans
tttctacaaaatt

SEQ ID NO: 741476 - DNA, 13 bp, C. elegans
tttctacaaagtt

SEQ ID NO: 741477 - DNA, 13 bp, C. elegans
tttctacaaattt

SEQ ID NO: 741478 - DNA, 13 bp, C. elegans
tttctacaacttt

SEQ ID NO: 741479 - DNA, 13 bp, C. elegans
tttctacaagaaa

SEQ ID NO: 741480 - DNA, 13 bp, C. elegans
tttctacaagttt

SEQ ID NO: 741481 - DNA, 13 bp, C. elegans
tttctacaatatc

SEQ ID NO: 741482 - DNA, 13 bp, C. elegans
tttctacaatgtc

SEQ ID NO: 741483 - DNA, 13 bp, C. elegans
tttctacaattca

SEQ ID NO: 741484 - DNA, 13 bp, C. elegans
tttctacacattt

SEQ ID NO: 741485 - DNA, 13 bp, C. elegans
tttctacactatt

SEQ ID NO: 741486 - DNA, 13 bp, C. elegans
tttctacagaaaa

SEQ ID NO: 741487 - DNA, 13 bp, C. elegans
tttctacagaaat

SEQ ID NO: 741488 - DNA, 13 bp, C. elegans
tttctacagtaac

SEQ ID NO: 741489 - DNA, 13 bp, C. elegans
tttctacagtact

SEQ ID NO: 741490 - DNA, 13 bp, C. elegans
tttctacatcaaa

SEQ ID NO: 741491 - DNA, 13 bp, C. elegans
tttctaccaaaat

SEQ ID NO: 741492 - DNA, 13 bp, C. elegans
tttctaccaaatt

SEQ ID NO: 741493 - DNA, 13 bp, C. elegans
tttctaccaattt

SEQ ID NO: 741494 - DNA, 13 bp, C. elegans
tttctaccagaaa

SEQ ID NO: 741495 - DNA, 13 bp, C. elegans
tttctaccatttc

SEQ ID NO: 741496 - DNA, 13 bp, C. elegans
tttctacccaaaa

SEQ ID NO: 741497 - DNA, 13 bp, C. elegans
tttctaccgaaaa

SEQ ID NO: 741498 - DNA, 13 bp, C. elegans
tttctacgaaaaa

SEQ ID NO: 741499 - DNA, 13 bp, C. elegans
tttctacgagttt

SEQ ID NO: 741500 - DNA, 13 bp, C. elegans
tttctacgatttt

SEQ ID NO: 741501 - DNA, 13 bp, C. elegans
tttctacggtttt

SEQ ID NO: 741502 - DNA, 13 bp, C. elegans
tttctactcaaaa

SEQ ID NO: 741503 - DNA, 13 bp, C. elegans
tttctactcgttt

SEQ ID NO: 741504 - DNA, 13 bp, C. elegans
tttctactggaaa

SEQ ID NO: 741505 - DNA, 13 bp, C. elegans
tttctactgtttc

SEQ ID NO: 741506 - DNA, 13 bp, C. elegans
tttctacttcaaa

SEQ ID NO: 741507 - DNA, 13 bp, C. elegans
tttctactttgcc

SEQ ID NO: 741508 - DNA, 14 bp, C. elegans
tttctactttgcca

SEQ ID NO: 741509 - DNA, 13 bp, C. elegans
tttctacttttga

SEQ ID NO: 741510 - DNA, 13 bp, C. elegans
tttctagaaaaaa

SEQ ID NO: 741511 - DNA, 13 bp, C. elegans
tttctagaaaaat

SEQ ID NO: 741512 - DNA, 13 bp, C. elegans
tttctagaaaaca

SEQ ID NO: 741513 - DNA, 13 bp, C. elegans
tttctagaaaatg

SEQ ID NO: 741514 - DNA, 13 bp, C. elegans
tttctagaaaatt

SEQ ID NO: 741515 - DNA, 13 bp, C. elegans
tttctagaaactt

SEQ ID NO: 741516 - DNA, 13 bp, C. elegans
tttctagaaattc

SEQ ID NO: 741517 - DNA, 13 bp, C. elegans
tttctagaaattt

SEQ ID NO: 741518 - DNA, 13 bp, C. elegans
tttctagaaggtt

SEQ ID NO: 741519 - DNA, 13 bp, C. elegans
tttctagaattaa

SEQ ID NO: 741520 - DNA, 13 bp, C. elegans
tttctagatttta

SEQ ID NO: 741521 - DNA, 13 bp, C. elegans
tttctagcaaaat

SEQ ID NO: 741522 - DNA, 13 bp, C. elegans
tttctagcatttt

SEQ ID NO: 741523 - DNA, 13 bp, C. elegans
tttctaggcattt

SEQ ID NO: 741524 - DNA, 13 bp, C. elegans
tttctaggccacc

SEQ ID NO: 741525 - DNA, 13 bp, C. elegans
tttctaggccacg

SEQ ID NO: 741526 - DNA, 13 bp, C. elegans
tttctaggcgaaa

SEQ ID NO: 741527 - DNA, 13 bp, C. elegans
tttctaggtttta

SEQ ID NO: 741528 - DNA, 13 bp, C. elegans
tttctagtaattt

SEQ ID NO: 741529 - DNA, 13 bp, C. elegans
tttctagtatttc

SEQ ID NO: 741530 - DNA, 13 bp, C. elegans
tttctagtggaaa

SEQ ID NO: 741531 - DNA, 13 bp, C. elegans
tttctagtttcta

SEQ ID NO: 741532 - DNA, 13 bp, C. elegans
tttctagtttgga

SEQ ID NO: 741533 - DNA, 13 bp, C. elegans
tttctagttttgc

SEQ ID NO: 741534 - DNA, 13 bp, C. elegans
tttctataaaaca

SEQ ID NO: 741535 - DNA, 13 bp, C. elegans
tttctataaagtt

SEQ ID NO: 741536 - DNA, 13 bp, C. elegans
tttctataaattc

SEQ ID NO: 741537 - DNA, 13 bp, C. elegans
tttctataatttg

SEQ ID NO: 741538 - DNA, 13 bp, C. elegans
tttctatagaaaa

SEQ ID NO: 741539 - DNA, 13 bp, C. elegans
tttctatagattt

SEQ ID NO: 741540 - DNA, 13 bp, C. elegans
tttctatcatcat

SEQ ID NO: 741541 - DNA, 13 bp, C. elegans
tttctatccaaaa

SEQ ID NO: 741542 - DNA, 13 bp, C. elegans
tttctatcgaaaa

SEQ ID NO: 741543 - DNA, 13 bp, C. elegans
tttctatcgaatt

SEQ ID NO: 741544 - DNA, 13 bp, C. elegans
tttctatgaaaaa

SEQ ID NO: 741545 - DNA, 13 bp, C. elegans
tttctatgaagaa

SEQ ID NO: 741546 - DNA, 13 bp, C. elegans
tttctatgaagtt

SEQ ID NO: 741547 - DNA, 13 bp, C. elegans
tttctatgaattt

SEQ ID NO: 741548 - DNA, 13 bp, C. elegans
tttctatgatatt

SEQ ID NO: 741549 - DNA, 13 bp, C. elegans
tttctatgatttc

SEQ ID NO: 741550 - DNA, 13 bp, C. elegans
tttctatgtcaaa

SEQ ID NO: 741551 - DNA, 13 bp, C. elegans
tttctatgtctct

SEQ ID NO: 741552 - DNA, 13 bp, C. elegans
tttctattgcatt

SEQ ID NO: 741553 - DNA, 13 bp, C. elegans
tttctattggaaa

SEQ ID NO: 741554 - DNA, 13 bp, C. elegans
tttctatttcaaa

SEQ ID NO: 741555 - DNA, 13 bp, C. elegans
tttctatttctag

SEQ ID NO: 741556 - DNA, 13 bp, C. elegans
tttctatttctga

SEQ ID NO: 741557 - DNA, 13 bp, C. elegans
tttctatttgtaa

SEQ ID NO: 741558 - DNA, 13 bp, C. elegans
tttctattttcag

SEQ ID NO: 741559 - DNA, 13 bp, C. elegans
tttctattttccg

SEQ ID NO: 741560 - DNA, 13 bp, C. elegans
tttctattttgga

SEQ ID NO: 741561 - DNA, 13 bp, C. elegans
tttctcaaaaaac

SEQ ID NO: 741562 - DNA, 13 bp, C. elegans
tttctcaaaaact

SEQ ID NO: 741563 - DNA, 13 bp, C. elegans
tttctcaaaacct

SEQ ID NO: 741564 - DNA, 13 bp, C. elegans
tttctcaaaacta

SEQ ID NO: 741565 - DNA, 13 bp, C. elegans
tttctcaaaagct

SEQ ID NO: 741566 - DNA, 13 bp, C. elegans
tttctcaaaatct

SEQ ID NO: 741567 - DNA, 13 bp, C. elegans
tttctcaaaattc

SEQ ID NO: 741568 - DNA, 13 bp, C. elegans
tttctcaaaattg

SEQ ID NO: 741569 - DNA, 13 bp, C. elegans
tttctcaaaattt

SEQ ID NO: 741570 - DNA, 13 bp, C. elegans
tttctcaaacatt

SEQ ID NO: 741571 - DNA, 13 bp, C. elegans
tttctcaaatctt

SEQ ID NO: 741572 - DNA, 13 bp, C. elegans
tttctcaaattca

SEQ ID NO: 741573 - DNA, 13 bp, C. elegans
tttctcaaatttc

SEQ ID NO: 741574 - DNA, 13 bp, C. elegans
tttctcaaatttg

SEQ ID NO: 741575 - DNA, 13 bp, C. elegans
tttctcaacaaaa

SEQ ID NO: 741576 - DNA, 13 bp, C. elegans
tttctcaacaaat

SEQ ID NO: 741577 - DNA, 13 bp, C. elegans
tttctcaacaact

SEQ ID NO: 741578 - DNA, 13 bp, C. elegans
tttctcaacaatt

SEQ ID NO: 741579 - DNA, 13 bp, C. elegans
tttctcaacagtt

SEQ ID NO: 741580 - DNA, 13 bp, C. elegans
tttctcaaccaaa

SEQ ID NO: 741581 - DNA, 13 bp, C. elegans
tttctcaactgat

SEQ ID NO: 741582 - DNA, 13 bp, C. elegans
tttctcaacttca

SEQ ID NO: 741583 - DNA, 13 bp, C. elegans
tttctcaacttga

SEQ ID NO: 741584 - DNA, 13 bp, C. elegans
tttctcaagaaaa

SEQ ID NO: 741585 - DNA, 13 bp, C. elegans
tttctcaagaaat

SEQ ID NO: 741586 - DNA, 13 bp, C. elegans
tttctcaagattt

SEQ ID NO: 741587 - DNA, 13 bp, C. elegans
tttctcaagttgt

SEQ ID NO: 741588 - DNA, 13 bp, C. elegans
tttctcaagtttc

SEQ ID NO: 741589 - DNA, 13 bp, C. elegans
tttctcaataata

SEQ ID NO: 741590 - DNA, 13 bp, C. elegans
tttctcaatatta

SEQ ID NO: 741591 - DNA, 13 bp, C. elegans
tttctcaatgaaa

SEQ ID NO: 741592 - DNA, 13 bp, C. elegans
tttctcaattcat

SEQ ID NO: 741593 - DNA, 13 bp, C. elegans
tttctcaatttca

SEQ ID NO: 741594 - DNA, 13 bp, C. elegans
tttctcaatttcc

SEQ ID NO: 741595 - DNA, 13 bp, C. elegans
tttctcaatttgt

SEQ ID NO: 741596 - DNA, 13 bp, C. elegans
tttctcaattttg

SEQ ID NO: 741597 - DNA, 13 bp, C. elegans
tttctcacaaaaa

SEQ ID NO: 741598 - DNA, 13 bp, C. elegans
tttctcacaaagt

SEQ ID NO: 741599 - DNA, 13 bp, C. elegans
tttctcacaattt

SEQ ID NO: 741600 - DNA, 13 bp, C. elegans
tttctcacattta

SEQ ID NO: 741601 - DNA, 13 bp, C. elegans
tttctcacgattt

SEQ ID NO: 741602 - DNA, 13 bp, C. elegans
tttctcactgaaa

SEQ ID NO: 741603 - DNA, 13 bp, C. elegans
tttctcagaaact

SEQ ID NO: 741604 - DNA, 13 bp, C. elegans
tttctcagaaatt

SEQ ID NO: 741605 - DNA, 13 bp, C. elegans
tttctcagaatat

SEQ ID NO: 741606 - DNA, 13 bp, C. elegans
tttctcagatttc

SEQ ID NO: 741607 - DNA, 13 bp, C. elegans
tttctcagctttt

SEQ ID NO: 741608 - DNA, 13 bp, C. elegans
tttctcaggaaat

SEQ ID NO: 741609 - DNA, 13 bp, C. elegans
tttctcagttgaa

SEQ ID NO: 741610 - DNA, 13 bp, C. elegans
tttctcagtttct

SEQ ID NO: 741611 - DNA, 13 bp, C. elegans
tttctcataactt

SEQ ID NO: 741612 - DNA, 13 bp, C. elegans
tttctcataatca

SEQ ID NO: 741613 - DNA, 13 bp, C. elegans
tttctcatcaaaa

SEQ ID NO: 741614 - DNA, 13 bp, C. elegans
tttctcatcaaat

SEQ ID NO: 741615 - DNA, 13 bp, C. elegans
tttctcatcaatt

SEQ ID NO: 741616 - DNA, 13 bp, C. elegans
tttctcatgattt

SEQ ID NO: 741617 - DNA, 13 bp, C. elegans
tttctcatgggtt

SEQ ID NO: 741618 - DNA, 13 bp, C. elegans
tttctcattaaac

SEQ ID NO: 741619 - DNA, 13 bp, C. elegans
tttctcattcaaa

SEQ ID NO: 741620 - DNA, 13 bp, C. elegans
tttctcattcact

SEQ ID NO: 741621 - DNA, 13 bp, C. elegans
tttctcatttcaa

SEQ ID NO: 741622 - DNA, 13 bp, C. elegans
tttctcatttctg

SEQ ID NO: 741623 - DNA, 13 bp, C. elegans
tttctcatttgaa

SEQ ID NO: 741624 - DNA, 13 bp, C. elegans
tttctcattttgc

SEQ ID NO: 741625 - DNA, 13 bp, C. elegans
tttctccaaaaag

SEQ ID NO: 741626 - DNA, 13 bp, C. elegans
tttctccaaaaat

SEQ ID NO: 741627 - DNA, 13 bp, C. elegans
tttctccaaaact

SEQ ID NO: 741628 - DNA, 13 bp, C. elegans
tttctccaaaagt

SEQ ID NO: 741629 - DNA, 13 bp, C. elegans
tttctccaaacaa

SEQ ID NO: 741630 - DNA, 13 bp, C. elegans
tttctccaaatct

SEQ ID NO: 741631 - DNA, 13 bp, C. elegans
tttctccaaattc

SEQ ID NO: 741632 - DNA, 13 bp, C. elegans
tttctccaaattt

SEQ ID NO: 741633 - DNA, 13 bp, C. elegans
tttctccaacttt

SEQ ID NO: 741634 - DNA, 13 bp, C. elegans
tttctccaagaaa

SEQ ID NO: 741635 - DNA, 13 bp, C. elegans
tttctccaatatt

SEQ ID NO: 741636 - DNA, 13 bp, C. elegans
tttctccaatttg

SEQ ID NO: 741637 - DNA, 13 bp, C. elegans
tttctccaccaaa

SEQ ID NO: 741638 - DNA, 13 bp, C. elegans
tttctccagtttt

SEQ ID NO: 741639 - DNA, 13 bp, C. elegans
tttctccgaaaaa

SEQ ID NO: 741640 - DNA, 13 bp, C. elegans
tttctccgatttt

SEQ ID NO: 741641 - DNA, 13 bp, C. elegans
tttctccggaatt

SEQ ID NO: 741642 - DNA, 13 bp, C. elegans
tttctccgtttca

SEQ ID NO: 741643 - DNA, 13 bp, C. elegans
tttctcctcaatt

SEQ ID NO: 741644 - DNA, 13 bp, C. elegans
tttctcgaaaaaa

SEQ ID NO: 741645 - DNA, 13 bp, C. elegans
tttctcgaaaaac

SEQ ID NO: 741646 - DNA, 13 bp, C. elegans
tttctcgaaattt

SEQ ID NO: 741647 - DNA, 13 bp, C. elegans
tttctcgaacttc

SEQ ID NO: 741648 - DNA, 13 bp, C. elegans
tttctcgaacttt

SEQ ID NO: 741649 - DNA, 13 bp, C. elegans
tttctcgaagaaa

SEQ ID NO: 741650 - DNA, 13 bp, C. elegans
tttctcgaagatc

SEQ ID NO: 741651 - DNA, 13 bp, C. elegans
tttctcgaagcaa

SEQ ID NO: 741652 - DNA, 13 bp, C. elegans
tttctcgaagttt

SEQ ID NO: 741653 - DNA, 13 bp, C. elegans
tttctcgaataaa

SEQ ID NO: 741654 - DNA, 13 bp, C. elegans
tttctcgaatttt

SEQ ID NO: 741655 - DNA, 13 bp, C. elegans
tttctcgacattt

SEQ ID NO: 741656 - DNA, 13 bp, C. elegans
tttctcgactttt

SEQ ID NO: 741657 - DNA, 13 bp, C. elegans
tttctcgagtttt

SEQ ID NO: 741658 - DNA, 13 bp, C. elegans
tttctcgattctt

SEQ ID NO: 741659 - DNA, 13 bp, C. elegans
tttctcgccaaaa

SEQ ID NO: 741660 - DNA, 13 bp, C. elegans
tttctcggacata

SEQ ID NO: 741661 - DNA, 13 bp, C. elegans
tttctcgggaaaa

SEQ ID NO: 741662 - DNA, 13 bp, C. elegans
tttctcgtcattt

SEQ ID NO: 741663 - DNA, 13 bp, C. elegans
tttctcgtgattt

SEQ ID NO: 741664 - DNA, 13 bp, C. elegans
tttctcgttaaaa

SEQ ID NO: 741665 - DNA, 13 bp, C. elegans
tttctcgttttca

SEQ ID NO: 741666 - DNA, 13 bp, C. elegans
tttctctaaaaac

SEQ ID NO: 741667 - DNA, 13 bp, C. elegans
tttctctaaaatt

SEQ ID NO: 741668 - DNA, 13 bp, C. elegans
tttctctaaatta

SEQ ID NO: 741669 - DNA, 13 bp, C. elegans
tttctctaattgt

SEQ ID NO: 741670 - DNA, 13 bp, C. elegans
tttctctacaatt

SEQ ID NO: 741671 - DNA, 13 bp, C. elegans
tttctctatagtt

SEQ ID NO: 741672 - DNA, 13 bp, C. elegans
tttctctattaaa

SEQ ID NO: 741673 - DNA, 13 bp, C. elegans
tttctctattagt

SEQ ID NO: 741674 - DNA, 13 bp, C. elegans
tttctctcaaaaa

SEQ ID NO: 741675 - DNA, 13 bp, C. elegans
tttctctcaactt

SEQ ID NO: 741676 - DNA, 13 bp, C. elegans
tttctctcaattg

SEQ ID NO: 741677 - DNA, 13 bp, C. elegans
tttctctccaaat

SEQ ID NO: 741678 - DNA, 13 bp, C. elegans
tttctctcgaaaa

SEQ ID NO: 741679 - DNA, 13 bp, C. elegans
tttctctcgattt

SEQ ID NO: 741680 - DNA, 13 bp, C. elegans
tttctctctaaat

SEQ ID NO: 741681 - DNA, 13 bp, C. elegans
tttctctctgaaa

SEQ ID NO: 741682 - DNA, 13 bp, C. elegans
tttctctcttcaa

SEQ ID NO: 741683 - DNA, 13 bp, C. elegans
tttctctgaactt

SEQ ID NO: 741684 - DNA, 13 bp, C. elegans
tttctctgaataa

SEQ ID NO: 741685 - DNA, 13 bp, C. elegans
tttctctgattct

SEQ ID NO: 741686 - DNA, 13 bp, C. elegans
tttctctgcaaaa

SEQ ID NO: 741687 - DNA, 13 bp, C. elegans
tttctctgcattt

SEQ ID NO: 741688 - DNA, 13 bp, C. elegans
tttctctgcgtct

SEQ ID NO: 741689 - DNA, 13 bp, C. elegans
tttctctgtgctc

SEQ ID NO: 741690 - DNA, 13 bp, C. elegans
tttctctgtttca

SEQ ID NO: 741691 - DNA, 13 bp, C. elegans
tttctcttaaaat

SEQ ID NO: 741692 - DNA, 13 bp, C. elegans
tttctcttcaaaa

SEQ ID NO: 741693 - DNA, 13 bp, C. elegans
tttctcttccaaa

SEQ ID NO: 741694 - DNA, 13 bp, C. elegans
tttctcttcgaaa

SEQ ID NO: 741695 - DNA, 13 bp, C. elegans
tttctcttgaatt

SEQ ID NO: 741696 - DNA, 13 bp, C. elegans
tttctgaaaaaaa

SEQ ID NO: 741697 - DNA, 13 bp, C. elegans
tttctgaaaaaac

SEQ ID NO: 741698 - DNA, 13 bp, C. elegans
tttctgaaaaact

SEQ ID NO: 741699 - DNA, 13 bp, C. elegans
tttctgaaaaatt

SEQ ID NO: 741700 - DNA, 13 bp, C. elegans
tttctgaaaacaa

SEQ ID NO: 741701 - DNA, 13 bp, C. elegans
tttctgaaaagct

SEQ ID NO: 741702 - DNA, 13 bp, C. elegans
tttctgaaaagta

SEQ ID NO: 741703 - DNA, 13 bp, C. elegans
tttctgaaaagtt

SEQ ID NO: 741704 - DNA, 13 bp, C. elegans
tttctgaaaatat

SEQ ID NO: 741705 - DNA, 13 bp, C. elegans
tttctgaaaatct

SEQ ID NO: 741706 - DNA, 13 bp, C. elegans
tttctgaaaatgc

SEQ ID NO: 741707 - DNA, 13 bp, C. elegans
tttctgaaaatta

SEQ ID NO: 741708 - DNA, 13 bp, C. elegans
tttctgaaaattg

SEQ ID NO: 741709 - DNA, 13 bp, C. elegans
tttctgaaaattt

SEQ ID NO: 741710 - DNA, 13 bp, C. elegans
tttctgaaacaga

SEQ ID NO: 741711 - DNA, 13 bp, C. elegans
tttctgaaacatt

SEQ ID NO: 741712 - DNA, 13 bp, C. elegans
tttctgaaactaa

SEQ ID NO: 741713 - DNA, 13 bp, C. elegans
tttctgaaactat

SEQ ID NO: 741714 - DNA, 13 bp, C. elegans
tttctgaaactca

SEQ ID NO: 741715 - DNA, 13 bp, C. elegans
tttctgaaacttc

SEQ ID NO: 741716 - DNA, 13 bp, C. elegans
tttctgaaacttg

SEQ ID NO: 741717 - DNA, 13 bp, C. elegans
tttctgaaagaaa

SEQ ID NO: 741718 - DNA, 13 bp, C. elegans
tttctgaaagaca

SEQ ID NO: 741719 - DNA, 13 bp, C. elegans
tttctgaaagtta

SEQ ID NO: 741720 - DNA, 13 bp, C. elegans
tttctgaaagttt

SEQ ID NO: 741721 - DNA, 13 bp, C. elegans
tttctgaaatatt

SEQ ID NO: 741722 - DNA, 13 bp, C. elegans
tttctgaaatgat

SEQ ID NO: 741723 - DNA, 13 bp, C. elegans
tttctgaaattct

SEQ ID NO: 741724 - DNA, 13 bp, C. elegans
tttctgaaatttc

SEQ ID NO: 741725 - DNA, 13 bp, C. elegans
tttctgaacacaa

SEQ ID NO: 741726 - DNA, 13 bp, C. elegans
tttctgaacacat

SEQ ID NO: 741727 - DNA, 13 bp, C. elegans
tttctgaacattt

SEQ ID NO: 741728 - DNA, 13 bp, C. elegans
tttctgaacttca

SEQ ID NO: 741729 - DNA, 13 bp, C. elegans
tttctgaactttg

SEQ ID NO: 741730 - DNA, 13 bp, C. elegans
tttctgaatagtt

SEQ ID NO: 741731 - DNA, 13 bp, C. elegans
tttctgaatatca

SEQ ID NO: 741732 - DNA, 13 bp, C. elegans
tttctgaatatct

SEQ ID NO: 741733 - DNA, 13 bp, C. elegans
tttctgaattaaa

SEQ ID NO: 741734 - DNA, 13 bp, C. elegans
tttctgaattctc

SEQ ID NO: 741735 - DNA, 13 bp, C. elegans
tttctgaatttcc

SEQ ID NO: 741736 - DNA, 13 bp, C. elegans
tttctgaatttta

SEQ ID NO: 741737 - DNA, 13 bp, C. elegans
tttctgaattttg

SEQ ID NO: 741738 - DNA, 13 bp, C. elegans
tttctgacaaagt

SEQ ID NO: 741739 - DNA, 13 bp, C. elegans
tttctgacaattt

SEQ ID NO: 741740 - DNA, 13 bp, C. elegans
tttctgacagttt

SEQ ID NO: 741741 - DNA, 13 bp, C. elegans
tttctgacatttt

SEQ ID NO: 741742 - DNA, 13 bp, C. elegans
tttctgacgaaaa

SEQ ID NO: 741743 - DNA, 13 bp, C. elegans
tttctgacgtttt

SEQ ID NO: 741744 - DNA, 13 bp, C. elegans
tttctgactgatt

SEQ ID NO: 741745 - DNA, 13 bp, C. elegans
tttctgactttaa

SEQ ID NO: 741746 - DNA, 13 bp, C. elegans
tttctgactttca

SEQ ID NO: 741747 - DNA, 13 bp, C. elegans
tttctgactttga

SEQ ID NO: 741748 - DNA, 13 bp, C. elegans
tttctgagaaatt

SEQ ID NO: 741749 - DNA, 13 bp, C. elegans
tttctgagaacaa

SEQ ID NO: 741750 - DNA, 13 bp, C. elegans
tttctgagatttt

SEQ ID NO: 741751 - DNA, 13 bp, C. elegans
tttctgagcattt

SEQ ID NO: 741752 - DNA, 13 bp, C. elegans
tttctgagctttt

SEQ ID NO: 741753 - DNA, 13 bp, C. elegans
tttctgaggaatt

SEQ ID NO: 741754 - DNA, 13 bp, C. elegans
tttctgataatta

SEQ ID NO: 741755 - DNA, 13 bp, C. elegans
tttctgatagttt

SEQ ID NO: 741756 - DNA, 13 bp, C. elegans
tttctgatataaa

SEQ ID NO: 741757 - DNA, 13 bp, C. elegans
tttctgatattat

SEQ ID NO: 741758 - DNA, 13 bp, C. elegans
tttctgatattcc

SEQ ID NO: 741759 - DNA, 13 bp, C. elegans
tttctgatattct

SEQ ID NO: 741760 - DNA, 13 bp, C. elegans
tttctgatatttc

SEQ ID NO: 741761 - DNA, 13 bp, C. elegans
tttctgatatttg

SEQ ID NO: 741762 - DNA, 13 bp, C. elegans
tttctgatcaaat

SEQ ID NO: 741763 - DNA, 13 bp, C. elegans
tttctgatcagtt

SEQ ID NO: 741764 - DNA, 13 bp, C. elegans
tttctgatcgttt

SEQ ID NO: 741765 - DNA, 13 bp, C. elegans
tttctgatctaaa

SEQ ID NO: 741766 - DNA, 13 bp, C. elegans
tttctgatgattt

SEQ ID NO: 741767 - DNA, 13 bp, C. elegans
tttctgatggttt

SEQ ID NO: 741768 - DNA, 13 bp, C. elegans
tttctgattaaaa

SEQ ID NO: 741769 - DNA, 13 bp, C. elegans
tttctgattccaa

SEQ ID NO: 741770 - DNA, 13 bp, C. elegans
tttctgatttcct

SEQ ID NO: 741771 - DNA, 13 bp, C. elegans
tttctgatttcta

SEQ ID NO: 741772 - DNA, 13 bp, C. elegans
tttctgatttctc

SEQ ID NO: 741773 - DNA, 13 bp, C. elegans
tttctgcaaaagt

SEQ ID NO: 741774 - DNA, 13 bp, C. elegans
tttctgcaaattt

SEQ ID NO: 741775 - DNA, 13 bp, C. elegans
tttctgcaactgc

SEQ ID NO: 741776 - DNA, 13 bp, C. elegans
tttctgcaataat

SEQ ID NO: 741777 - DNA, 13 bp, C. elegans
tttctgcaattta

SEQ ID NO: 741778 - DNA, 13 bp, C. elegans
tttctgcaatttt

SEQ ID NO: 741779 - DNA, 13 bp, C. elegans
tttctgcagaatt

SEQ ID NO: 741780 - DNA, 13 bp, C. elegans
tttctgcagtttt

SEQ ID NO: 741781 - DNA, 13 bp, C. elegans
tttctgcataaaa

SEQ ID NO: 741782 - DNA, 13 bp, C. elegans
tttctgcatattt

SEQ ID NO: 741783 - DNA, 13 bp, C. elegans
tttctgcatttct

SEQ ID NO: 741784 - DNA, 13 bp, C. elegans
tttctgccaacaa

SEQ ID NO: 741785 - DNA, 13 bp, C. elegans
tttctgccaattt

SEQ ID NO: 741786 - DNA, 14 bp, C. elegans
tttctgccattcac

SEQ ID NO: 741787 - DNA, 13 bp, C. elegans
tttctgccatttt

SEQ ID NO: 741788 - DNA, 13 bp, C. elegans
tttctgcccgaaa

SEQ ID NO: 741789 - DNA, 13 bp, C. elegans
tttctgccgattt

SEQ ID NO: 741790 - DNA, 13 bp, C. elegans
tttctgcctacct

SEQ ID NO: 741791 - DNA, 13 bp, C. elegans
tttctgcctgcct

SEQ ID NO: 741792 - DNA, 13 bp, C. elegans
tttctgcgatttt

SEQ ID NO: 741793 - DNA, 13 bp, C. elegans
tttctgctcattt

SEQ ID NO: 741794 - DNA, 13 bp, C. elegans
tttctgctgattt

SEQ ID NO: 741795 - DNA, 13 bp, C. elegans
tttctgctttgaa

SEQ ID NO: 741796 - DNA, 13 bp, C. elegans
tttctggaaaact

SEQ ID NO: 741797 - DNA, 13 bp, C. elegans
tttctggaaatat

SEQ ID NO: 741798 - DNA, 13 bp, C. elegans
tttctggaaattt

SEQ ID NO: 741799 - DNA, 13 bp, C. elegans
tttctggaacttt

SEQ ID NO: 741800 - DNA, 13 bp, C. elegans
tttctggaagaaa

SEQ ID NO: 741801 - DNA, 13 bp, C. elegans
tttctggaagttt

SEQ ID NO: 741802 - DNA, 13 bp, C. elegans
tttctggaattat

SEQ ID NO: 741803 - DNA, 13 bp, C. elegans
tttctggaattcc

SEQ ID NO: 741804 - DNA, 13 bp, C. elegans
tttctggaattta

SEQ ID NO: 741805 - DNA, 13 bp, C. elegans
tttctggaatttc

SEQ ID NO: 741806 - DNA, 13 bp, C. elegans
tttctggaatttt

SEQ ID NO: 741807 - DNA, 13 bp, C. elegans
tttctggagaaaa

SEQ ID NO: 741808 - DNA, 13 bp, C. elegans
tttctggagaatt

SEQ ID NO: 741809 - DNA, 13 bp, C. elegans
tttctggagattt

SEQ ID NO: 741810 - DNA, 13 bp, C. elegans
tttctggcaaacc

SEQ ID NO: 741811 - DNA, 13 bp, C. elegans
tttctggcaattt

SEQ ID NO: 741812 - DNA, 13 bp, C. elegans
tttctggcagttt

SEQ ID NO: 741813 - DNA, 13 bp, C. elegans
tttctgggaaaat

SEQ ID NO: 741814 - DNA, 13 bp, C. elegans
tttctgggaattt

SEQ ID NO: 741815 - DNA, 13 bp, C. elegans
tttctgggcgaaa

SEQ ID NO: 741816 - DNA, 13 bp, C. elegans
tttctggggaaaa

SEQ ID NO: 741817 - DNA, 13 bp, C. elegans
tttctggtaattt

SEQ ID NO: 741818 - DNA, 13 bp, C. elegans
tttctggtagaaa

SEQ ID NO: 741819 - DNA, 13 bp, C. elegans
tttctggtcaaaa

SEQ ID NO: 741820 - DNA, 13 bp, C. elegans
tttctggtgcaaa

SEQ ID NO: 741821 - DNA, 13 bp, C. elegans
tttctggttgaaa

SEQ ID NO: 741822 - DNA, 13 bp, C. elegans
tttctggttttca

SEQ ID NO: 741823 - DNA, 13 bp, C. elegans
tttctgtaaaaat

SEQ ID NO: 741824 - DNA, 13 bp, C. elegans
tttctgtaaaaca

SEQ ID NO: 741825 - DNA, 13 bp, C. elegans
tttctgtaaaacc

SEQ ID NO: 741826 - DNA, 13 bp, C. elegans
tttctgtaaaatc

SEQ ID NO: 741827 - DNA, 13 bp, C. elegans
tttctgtaaataa

SEQ ID NO: 741828 - DNA, 13 bp, C. elegans
tttctgtaaattg

SEQ ID NO: 741829 - DNA, 13 bp, C. elegans
tttctgtaactaa

SEQ ID NO: 741830 - DNA, 13 bp, C. elegans
tttctgtaagaaa

SEQ ID NO: 741831 - DNA, 13 bp, C. elegans
tttctgtaataaa

SEQ ID NO: 741832 - DNA, 13 bp, C. elegans
tttctgtaatttc

SEQ ID NO: 741833 - DNA, 13 bp, C. elegans
tttctgtacaaaa

SEQ ID NO: 741834 - DNA, 13 bp, C. elegans
tttctgtacattt

SEQ ID NO: 741835 - DNA, 13 bp, C. elegans
tttctgtagatca

SEQ ID NO: 741836 - DNA, 13 bp, C. elegans
tttctgtagtctt

SEQ ID NO: 741837 - DNA, 13 bp, C. elegans
tttctgtagtttc

SEQ ID NO: 741838 - DNA, 13 bp, C. elegans
tttctgtatcaaa

SEQ ID NO: 741839 - DNA, 13 bp, C. elegans
tttctgtatgaaa

SEQ ID NO: 741840 - DNA, 13 bp, C. elegans
tttctgtattaaa

SEQ ID NO: 741841 - DNA, 13 bp, C. elegans
tttctgtattaca

SEQ ID NO: 741842 - DNA, 13 bp, C. elegans
tttctgtcaaaat

SEQ ID NO: 741843 - DNA, 13 bp, C. elegans
tttctgtcaagaa

SEQ ID NO: 741844 - DNA, 13 bp, C. elegans
tttctgtcatatt

SEQ ID NO: 741845 - DNA, 13 bp, C. elegans
tttctgtccattt

SEQ ID NO: 741846 - DNA, 13 bp, C. elegans
tttctgtcgattt

SEQ ID NO: 741847 - DNA, 13 bp, C. elegans
tttctgtgaaaaa

SEQ ID NO: 741848 - DNA, 14 bp, C. elegans
tttctgtgaaaaat

SEQ ID NO: 741849 - DNA, 13 bp, C. elegans
tttctgtgaaaag

SEQ ID NO: 741850 - DNA, 13 bp, C. elegans
tttctgtgaaaat

SEQ ID NO: 741851 - DNA, 13 bp, C. elegans
tttctgtgaaaga

SEQ ID NO: 741852 - DNA, 13 bp, C. elegans
tttctgtgaactt

SEQ ID NO: 741853 - DNA, 13 bp, C. elegans
tttctgtgagaaa

SEQ ID NO: 741854 - DNA, 13 bp, C. elegans
tttctgtgatctt

SEQ ID NO: 741855 - DNA, 13 bp, C. elegans
tttctgtgcaaaa

SEQ ID NO: 741856 - DNA, 13 bp, C. elegans
tttctgtgcaatt

SEQ ID NO: 741857 - DNA, 13 bp, C. elegans
tttctgtgcattt

SEQ ID NO: 741858 - DNA, 13 bp, C. elegans
tttctgtggaaaa

SEQ ID NO: 741859 - DNA, 13 bp, C. elegans
tttctgtgtcgac

SEQ ID NO: 741860 - DNA, 13 bp, C. elegans
tttctgttaaaaa

SEQ ID NO: 741861 - DNA, 13 bp, C. elegans
tttctgttaactt

SEQ ID NO: 741862 - DNA, 13 bp, C. elegans
tttctgttccatt

SEQ ID NO: 741863 - DNA, 13 bp, C. elegans
tttctgttcttca

SEQ ID NO: 741864 - DNA, 13 bp, C. elegans
tttctgttgaaaa

SEQ ID NO: 741865 - DNA, 13 bp, C. elegans
tttctgttggaaa

SEQ ID NO: 741866 - DNA, 13 bp, C. elegans
tttctgtttaaaa

SEQ ID NO: 741867 - DNA, 13 bp, C. elegans
tttctgtttcaaa

SEQ ID NO: 741868 - DNA, 13 bp, C. elegans
tttctgtttcaag

SEQ ID NO: 741869 - DNA, 13 bp, C. elegans
tttctgtttcaga

SEQ ID NO: 741870 - DNA, 13 bp, C. elegans
tttctgttttcaa

SEQ ID NO: 741871 - DNA, 13 bp, C. elegans
tttcttaaaacaa

SEQ ID NO: 741872 - DNA, 13 bp, C. elegans
tttcttaaaacta

SEQ ID NO: 741873 - DNA, 13 bp, C. elegans
tttcttaaaatca

SEQ ID NO: 741874 - DNA, 13 bp, C. elegans
tttcttaaacatt

SEQ ID NO: 741875 - DNA, 13 bp, C. elegans
tttcttaaatgaa

SEQ ID NO: 741876 - DNA, 13 bp, C. elegans
tttcttaaattcc

SEQ ID NO: 741877 - DNA, 13 bp, C. elegans
tttcttaatgaaa

SEQ ID NO: 741878 - DNA, 13 bp, C. elegans
tttcttacaaaaa

SEQ ID NO: 741879 - DNA, 13 bp, C. elegans
tttcttacaatta

SEQ ID NO: 741880 - DNA, 13 bp, C. elegans
tttcttagaaaaa

SEQ ID NO: 741881 - DNA, 13 bp, C. elegans
tttcttagaatat

SEQ ID NO: 741882 - DNA, 13 bp, C. elegans
tttcttatcaact

SEQ ID NO: 741883 - DNA, 13 bp, C. elegans
tttcttatcagtt

SEQ ID NO: 741884 - DNA, 13 bp, C. elegans
tttcttatcataa

SEQ ID NO: 741885 - DNA, 13 bp, C. elegans
tttcttatcgatt

SEQ ID NO: 741886 - DNA, 13 bp, C. elegans
tttcttattcaaa

SEQ ID NO: 741887 - DNA, 13 bp, C. elegans
tttcttattcaca

SEQ ID NO: 741888 - DNA, 13 bp, C. elegans
tttcttcaaaaaa

SEQ ID NO: 741889 - DNA, 13 bp, C. elegans
tttcttcaaaaat

SEQ ID NO: 741890 - DNA, 13 bp, C. elegans
tttcttcaaaatt

SEQ ID NO: 741891 - DNA, 13 bp, C. elegans
tttcttcaaactg

SEQ ID NO: 741892 - DNA, 13 bp, C. elegans
tttcttcaaagtt

SEQ ID NO: 741893 - DNA, 13 bp, C. elegans
tttcttcaaataa

SEQ ID NO: 741894 - DNA, 13 bp, C. elegans
tttcttcaaatac

SEQ ID NO: 741895 - DNA, 14 bp, C. elegans
tttcttcaaattaa

SEQ ID NO: 741896 - DNA, 13 bp, C. elegans
tttcttcaaattg

SEQ ID NO: 741897 - DNA, 13 bp, C. elegans
tttcttcaacaat

SEQ ID NO: 741898 - DNA, 13 bp, C. elegans
tttcttcaacatt

SEQ ID NO: 741899 - DNA, 13 bp, C. elegans
tttcttcaagaaa

SEQ ID NO: 741900 - DNA, 13 bp, C. elegans
tttcttcaataat

SEQ ID NO: 741901 - DNA, 13 bp, C. elegans
tttcttcaatatc

SEQ ID NO: 741902 - DNA, 13 bp, C. elegans
tttcttcaatgaa

SEQ ID NO: 741903 - DNA, 13 bp, C. elegans
tttcttcaattca

SEQ ID NO: 741904 - DNA, 13 bp, C. elegans
tttcttcaattcc

SEQ ID NO: 741905 - DNA, 13 bp, C. elegans
tttcttcaattga

SEQ ID NO: 741906 - DNA, 13 bp, C. elegans
tttcttcaattgt

SEQ ID NO: 741907 - DNA, 13 bp, C. elegans
tttcttcacaaaa

SEQ ID NO: 741908 - DNA, 13 bp, C. elegans
tttcttcacggaa

SEQ ID NO: 741909 - DNA, 13 bp, C. elegans
tttcttcagaaaa

SEQ ID NO: 741910 - DNA, 13 bp, C. elegans
tttcttcagtttc

SEQ ID NO: 741911 - DNA, 13 bp, C. elegans
tttcttcatctca

SEQ ID NO: 741912 - DNA, 13 bp, C. elegans
tttcttcattcaa

SEQ ID NO: 741913 - DNA, 13 bp, C. elegans
tttcttcatttga

SEQ ID NO: 741914 - DNA, 13 bp, C. elegans
tttcttccaaaaa

SEQ ID NO: 741915 - DNA, 13 bp, C. elegans
tttcttccaataa

SEQ ID NO: 741916 - DNA, 13 bp, C. elegans
tttcttccaattg

SEQ ID NO: 741917 - DNA, 13 bp, C. elegans
tttcttccacaaa

SEQ ID NO: 741918 - DNA, 13 bp, C. elegans
tttcttccagaaa

SEQ ID NO: 741919 - DNA, 13 bp, C. elegans
tttcttccagttt

SEQ ID NO: 741920 - DNA, 13 bp, C. elegans
tttcttccgaaaa

SEQ ID NO: 741921 - DNA, 13 bp, C. elegans
tttcttcgaattg

SEQ ID NO: 741922 - DNA, 13 bp, C. elegans
tttcttcgaattt

SEQ ID NO: 741923 - DNA, 14 bp, C. elegans
tttcttcgagaaaa

SEQ ID NO: 741924 - DNA, 13 bp, C. elegans
tttcttcgatatt

SEQ ID NO: 741925 - DNA, 13 bp, C. elegans
tttcttctaaaaa

SEQ ID NO: 741926 - DNA, 13 bp, C. elegans
tttcttctcaaaa

SEQ ID NO: 741927 - DNA, 13 bp, C. elegans
tttcttctcatcg

SEQ ID NO: 741928 - DNA, 13 bp, C. elegans
tttcttctgaaat

SEQ ID NO: 741929 - DNA, 13 bp, C. elegans
tttcttctgaatt

SEQ ID NO: 741930 - DNA, 13 bp, C. elegans
tttcttctgtgaa

SEQ ID NO: 741931 - DNA, 13 bp, C. elegans
tttcttcttcgaa

SEQ ID NO: 741932 - DNA, 13 bp, C. elegans
tttcttctttgca

SEQ ID NO: 741933 - DNA, 13 bp, C. elegans
tttcttgaaaaaa

SEQ ID NO: 741934 - DNA, 13 bp, C. elegans
tttcttgaaaaat

SEQ ID NO: 741935 - DNA, 13 bp, C. elegans
tttcttgaaaact

SEQ ID NO: 741936 - DNA, 13 bp, C. elegans
tttcttgaaaatc

SEQ ID NO: 741937 - DNA, 13 bp, C. elegans
tttcttgaaaatg

SEQ ID NO: 741938 - DNA, 13 bp, C. elegans
tttcttgaaagtt

SEQ ID NO: 741939 - DNA, 13 bp, C. elegans
tttcttgaaatat

SEQ ID NO: 741940 - DNA, 13 bp, C. elegans
tttcttgaaatta

SEQ ID NO: 741941 - DNA, 13 bp, C. elegans
tttcttgaaattc

SEQ ID NO: 741942 - DNA, 13 bp, C. elegans
tttcttgaaattt

SEQ ID NO: 741943 - DNA, 13 bp, C. elegans
tttcttgaacatt

SEQ ID NO: 741944 - DNA, 13 bp, C. elegans
tttcttgaacgta

SEQ ID NO: 741945 - DNA, 13 bp, C. elegans
tttcttgaacttt

SEQ ID NO: 741946 - DNA, 13 bp, C. elegans
tttcttgaatcaa

SEQ ID NO: 741947 - DNA, 13 bp, C. elegans
tttcttgacacaa

SEQ ID NO: 741948 - DNA, 13 bp, C. elegans
tttcttgatcaac

SEQ ID NO: 741949 - DNA, 13 bp, C. elegans
tttcttgatttca

SEQ ID NO: 741950 - DNA, 13 bp, C. elegans
tttcttgcagaaa

SEQ ID NO: 741951 - DNA, 13 bp, C. elegans
tttcttgcatatt

SEQ ID NO: 741952 - DNA, 13 bp, C. elegans
tttcttgcatttc

SEQ ID NO: 741953 - DNA, 13 bp, C. elegans
tttcttgccaaaa

SEQ ID NO: 741954 - DNA, 13 bp, C. elegans
tttcttgccaaat

SEQ ID NO: 741955 - DNA, 13 bp, C. elegans
tttcttgcgaaaa

SEQ ID NO: 741956 - DNA, 13 bp, C. elegans
tttcttgctaaaa

SEQ ID NO: 741957 - DNA, 13 bp, C. elegans
tttcttgctgaaa

SEQ ID NO: 741958 - DNA, 13 bp, C. elegans
tttcttggaaaaa

SEQ ID NO: 741959 - DNA, 13 bp, C. elegans
tttcttggaaaac

SEQ ID NO: 741960 - DNA, 13 bp, C. elegans
tttcttggaattc

SEQ ID NO: 741961 - DNA, 13 bp, C. elegans
tttcttggagttt

SEQ ID NO: 741962 - DNA, 13 bp, C. elegans
tttcttggatatt

SEQ ID NO: 741963 - DNA, 13 bp, C. elegans
tttcttggctaaa

SEQ ID NO: 741964 - DNA, 13 bp, C. elegans
tttcttggtttca

SEQ ID NO: 741965 - DNA, 13 bp, C. elegans
tttcttgtaaaat

SEQ ID NO: 741966 - DNA, 13 bp, C. elegans
tttcttgtcaaat

SEQ ID NO: 741967 - DNA, 13 bp, C. elegans
tttcttgtgaaaa

SEQ ID NO: 741968 - DNA, 13 bp, C. elegans
tttcttgttaaaa

SEQ ID NO: 741969 - DNA, 13 bp, C. elegans
tttcttgttgaaa

SEQ ID NO: 741970 - DNA, 13 bp, C. elegans
tttctttaaaaac

SEQ ID NO: 741971 - DNA, 13 bp, C. elegans
tttctttaaaact

SEQ ID NO: 741972 - DNA, 13 bp, C. elegans
tttctttaaaagt

SEQ ID NO: 741973 - DNA, 13 bp, C. elegans
tttctttaaatgt

SEQ ID NO: 741974 - DNA, 13 bp, C. elegans
tttctttagaaaa

SEQ ID NO: 741975 - DNA, 13 bp, C. elegans
tttctttagatat

SEQ ID NO: 741976 - DNA, 13 bp, C. elegans
tttctttatcaaa

SEQ ID NO: 741977 - DNA, 13 bp, C. elegans
tttctttcaaaaa

SEQ ID NO: 741978 - DNA, 13 bp, C. elegans
tttctttcaaaag

SEQ ID NO: 741979 - DNA, 13 bp, C. elegans
tttctttcaagaa

SEQ ID NO: 741980 - DNA, 13 bp, C. elegans
tttctttcagaaa

SEQ ID NO: 741981 - DNA, 13 bp, C. elegans
tttctttcagata

SEQ ID NO: 741982 - DNA, 13 bp, C. elegans
tttctttcaggaa

SEQ ID NO: 741983 - DNA, 13 bp, C. elegans
tttctttcccaat

SEQ ID NO: 741984 - DNA, 13 bp, C. elegans
tttctttctgaaa

SEQ ID NO: 741985 - DNA, 13 bp, C. elegans
tttctttgaaaaa

SEQ ID NO: 741986 - DNA, 13 bp, C. elegans
tttctttgaaaat

SEQ ID NO: 741987 - DNA, 13 bp, C. elegans
tttctttgaatat

SEQ ID NO: 741988 - DNA, 13 bp, C. elegans
tttctttgaattg

SEQ ID NO: 741989 - DNA, 13 bp, C. elegans
tttctttgacaat

SEQ ID NO: 741990 - DNA, 13 bp, C. elegans
tttctttgcaaaa

SEQ ID NO: 741991 - DNA, 13 bp, C. elegans
tttctttgccaaa

SEQ ID NO: 741992 - DNA, 13 bp, C. elegans
tttctttggaaaa

SEQ ID NO: 741993 - DNA, 13 bp, C. elegans
tttctttgtcaaa

SEQ ID NO: 741994 - DNA, 13 bp, C. elegans
tttctttgtgaaa

SEQ ID NO: 741995 - DNA, 13 bp, C. elegans
tttcttttcaaaa

SEQ ID NO: 741996 - DNA, 13 bp, C. elegans
tttcttttcagaa

SEQ ID NO: 741997 - DNA, 13 bp, C. elegans
tttcttttcatcg

SEQ ID NO: 741998 - DNA, 13 bp, C. elegans
tttcttttctaga

SEQ ID NO: 741999 - DNA, 13 bp, C. elegans
tttcttttgaaaa

SEQ ID NO: 742000 - DNA, 13 bp, C. elegans
tttcttttgaaat

SEQ ID NO: 742001 - DNA, 13 bp, C. elegans
tttcttttgcaaa

SEQ ID NO: 742002 - DNA, 13 bp, C. elegans
tttcttttgcaga

SEQ ID NO: 742003 - DNA, 13 bp, C. elegans
tttcttttggaat

SEQ ID NO: 742004 - DNA, 13 bp, C. elegans
tttctttttaaag

SEQ ID NO: 742005 - DNA, 13 bp, C. elegans
tttctttttaaga

SEQ ID NO: 742006 - DNA, 13 bp, C. elegans
tttctttttccag

SEQ ID NO: 742007 - DNA, 13 bp, C. elegans
tttctttttcgaa

SEQ ID NO: 742008 - DNA, 13 bp, C. elegans
tttctttttgaaa

SEQ ID NO: 742009 - DNA, 13 bp, C. elegans
tttctttttgaag

SEQ ID NO: 742010 - DNA, 13 bp, C. elegans
tttctttttgcaa

SEQ ID NO: 742011 - DNA, 13 bp, C. elegans
tttctttttggaa

SEQ ID NO: 742012 - DNA, 14 bp, C. elegans
tttctttttggaat

SEQ ID NO: 742013 - DNA, 13 bp, C. elegans
tttgaaaaaaaca

SEQ ID NO: 742014 - DNA, 13 bp, C. elegans
tttgaaaaaaagt

SEQ ID NO: 742015 - DNA, 13 bp, C. elegans
tttgaaaaaactc

SEQ ID NO: 742016 - DNA, 13 bp, C. elegans
tttgaaaaaactt

SEQ ID NO: 742017 - DNA, 13 bp, C. elegans
tttgaaaaaagtt

SEQ ID NO: 742018 - DNA, 13 bp, C. elegans
tttgaaaaaatca

SEQ ID NO: 742019 - DNA, 13 bp, C. elegans
tttgaaaaaatcg

SEQ ID NO: 742020 - DNA, 13 bp, C. elegans
tttgaaaaacaaa

SEQ ID NO: 742021 - DNA, 13 bp, C. elegans
tttgaaaaaccaa

SEQ ID NO: 742022 - DNA, 13 bp, C. elegans
tttgaaaaaccag

SEQ ID NO: 742023 - DNA, 13 bp, C. elegans
tttgaaaaactta

SEQ ID NO: 742024 - DNA, 13 bp, C. elegans
tttgaaaaacttc

SEQ ID NO: 742025 - DNA, 13 bp, C. elegans
tttgaaaaagagg

SEQ ID NO: 742026 - DNA, 13 bp, C. elegans
tttgaaaaagatg

SEQ ID NO: 742027 - DNA, 13 bp, C. elegans
tttgaaaaagcac

SEQ ID NO: 742028 - DNA, 13 bp, C. elegans
tttgaaaaaggta

SEQ ID NO: 742029 - DNA, 13 bp, C. elegans
tttgaaaaagtaa

SEQ ID NO: 742030 - DNA, 13 bp, C. elegans
tttgaaaaatagt

SEQ ID NO: 742031 - DNA, 13 bp, C. elegans
tttgaaaaatatg

SEQ ID NO: 742032 - DNA, 13 bp, C. elegans
tttgaaaaatcaa

SEQ ID NO: 742033 - DNA, 13 bp, C. elegans
tttgaaaaatcac

SEQ ID NO: 742034 - DNA, 13 bp, C. elegans
tttgaaaaatcag

SEQ ID NO: 742035 - DNA, 13 bp, C. elegans
tttgaaaaatctt

SEQ ID NO: 742036 - DNA, 13 bp, C. elegans
tttgaaaaatgaa

SEQ ID NO: 742037 - DNA, 13 bp, C. elegans
tttgaaaaatgat

SEQ ID NO: 742038 - DNA, 13 bp, C. elegans
tttgaaaaatgta

SEQ ID NO: 742039 - DNA, 13 bp, C. elegans
tttgaaaaattgc

SEQ ID NO: 742040 - DNA, 13 bp, C. elegans
tttgaaaaatttg

SEQ ID NO: 742041 - DNA, 13 bp, C. elegans
tttgaaaacaata

SEQ ID NO: 742042 - DNA, 13 bp, C. elegans
tttgaaaacagtt

SEQ ID NO: 742043 - DNA, 13 bp, C. elegans
tttgaaaaccgaa

SEQ ID NO: 742044 - DNA, 13 bp, C. elegans
tttgaaaacgaaa

SEQ ID NO: 742045 - DNA, 13 bp, C. elegans
tttgaaaacggtt

SEQ ID NO: 742046 - DNA, 13 bp, C. elegans
tttgaaaactcaa

SEQ ID NO: 742047 - DNA, 13 bp, C. elegans
tttgaaaactcac

SEQ ID NO: 742048 - DNA, 13 bp, C. elegans
tttgaaaactcca

SEQ ID NO: 742049 - DNA, 13 bp, C. elegans
tttgaaaactgta

SEQ ID NO: 742050 - DNA, 13 bp, C. elegans
tttgaaaacttga

SEQ ID NO: 742051 - DNA, 13 bp, C. elegans
tttgaaaactttc

SEQ ID NO: 742052 - DNA, 13 bp, C. elegans
tttgaaaagacaa

SEQ ID NO: 742053 - DNA, 13 bp, C. elegans
tttgaaaagattt

SEQ ID NO: 742054 - DNA, 13 bp, C. elegans
tttgaaaaggttt

SEQ ID NO: 742055 - DNA, 13 bp, C. elegans
tttgaaaagtgga

SEQ ID NO: 742056 - DNA, 13 bp, C. elegans
tttgaaaagtgtg

SEQ ID NO: 742057 - DNA, 13 bp, C. elegans
tttgaaaagttca

SEQ ID NO: 742058 - DNA, 13 bp, C. elegans
tttgaaaagttct

SEQ ID NO: 742059 - DNA, 13 bp, C. elegans
tttgaaaagttgt

SEQ ID NO: 742060 - DNA, 13 bp, C. elegans
tttgaaaagtttc

SEQ ID NO: 742061 - DNA, 13 bp, C. elegans
tttgaaaagtttt

SEQ ID NO: 742062 - DNA, 13 bp, C. elegans
tttgaaaataact

SEQ ID NO: 742063 - DNA, 13 bp, C. elegans
tttgaaaataatg

SEQ ID NO: 742064 - DNA, 13 bp, C. elegans
tttgaaaatacgt

SEQ ID NO: 742065 - DNA, 13 bp, C. elegans
tttgaaaatagca

SEQ ID NO: 742066 - DNA, 13 bp, C. elegans
tttgaaaatagta

SEQ ID NO: 742067 - DNA, 13 bp, C. elegans
tttgaaaatatct

SEQ ID NO: 742068 - DNA, 13 bp, C. elegans
tttgaaaatatga

SEQ ID NO: 742069 - DNA, 14 bp, C. elegans
tttgaaaatcaaaa

SEQ ID NO: 742070 - DNA, 13 bp, C. elegans
tttgaaaatcaat

SEQ ID NO: 742071 - DNA, 13 bp, C. elegans
tttgaaaatcata

SEQ ID NO: 742072 - DNA, 13 bp, C. elegans
tttgaaaatcgaa

SEQ ID NO: 742073 - DNA, 13 bp, C. elegans
tttgaaaatcgtc

SEQ ID NO: 742074 - DNA, 13 bp, C. elegans
tttgaaaatcgtt

SEQ ID NO: 742075 - DNA, 13 bp, C. elegans
tttgaaaatgata

SEQ ID NO: 742076 - DNA, 13 bp, C. elegans
tttgaaaatgcac

SEQ ID NO: 742077 - DNA, 13 bp, C. elegans
tttgaaaatgctt

SEQ ID NO: 742078 - DNA, 13 bp, C. elegans
tttgaaaatgtat

SEQ ID NO: 742079 - DNA, 14 bp, C. elegans
tttgaaaatgtttt

SEQ ID NO: 742080 - DNA, 13 bp, C. elegans
tttgaaaattaag

SEQ ID NO: 742081 - DNA, 13 bp, C. elegans
tttgaaaattaca

SEQ ID NO: 742082 - DNA, 13 bp, C. elegans
tttgaaaattcat

SEQ ID NO: 742083 - DNA, 13 bp, C. elegans
tttgaaaattcca

SEQ ID NO: 742084 - DNA, 13 bp, C. elegans
tttgaaaattcta

SEQ ID NO: 742085 - DNA, 13 bp, C. elegans
tttgaaaattctt

SEQ ID NO: 742086 - DNA, 13 bp, C. elegans
tttgaaaattgaa

SEQ ID NO: 742087 - DNA, 13 bp, C. elegans
tttgaaaattgca

SEQ ID NO: 742088 - DNA, 13 bp, C. elegans
tttgaaaattggt

SEQ ID NO: 742089 - DNA, 13 bp, C. elegans
tttgaaaattgta

SEQ ID NO: 742090 - DNA, 13 bp, C. elegans
tttgaaaatttca

SEQ ID NO: 742091 - DNA, 13 bp, C. elegans
tttgaaaatttcg

SEQ ID NO: 742092 - DNA, 13 bp, C. elegans
tttgaaacaaaac

SEQ ID NO: 742093 - DNA, 13 bp, C. elegans
tttgaaacaaatg

SEQ ID NO: 742094 - DNA, 13 bp, C. elegans
tttgaaacaaatt

SEQ ID NO: 742095 - DNA, 13 bp, C. elegans
tttgaaacaagaa

SEQ ID NO: 742096 - DNA, 13 bp, C. elegans
tttgaaacaataa

SEQ ID NO: 742097 - DNA, 13 bp, C. elegans
tttgaaacaattg

SEQ ID NO: 742098 - DNA, 13 bp, C. elegans
tttgaaacagaaa

SEQ ID NO: 742099 - DNA, 13 bp, C. elegans
tttgaaacagtga

SEQ ID NO: 742100 - DNA, 13 bp, C. elegans
tttgaaacatgaa

SEQ ID NO: 742101 - DNA, 13 bp, C. elegans
tttgaaacatgtc

SEQ ID NO: 742102 - DNA, 13 bp, C. elegans
tttgaaacatttg

SEQ ID NO: 742103 - DNA, 13 bp, C. elegans
tttgaaacatttt

SEQ ID NO: 742104 - DNA, 13 bp, C. elegans
tttgaaaccaaat

SEQ ID NO: 742105 - DNA, 13 bp, C. elegans
tttgaaaccaatt

SEQ ID NO: 742106 - DNA, 13 bp, C. elegans
tttgaaaccacaa

SEQ ID NO: 742107 - DNA, 13 bp, C. elegans
tttgaaaccggaa

SEQ ID NO: 742108 - DNA, 13 bp, C. elegans
tttgaaacgaaat

SEQ ID NO: 742109 - DNA, 13 bp, C. elegans
tttgaaacgattt

SEQ ID NO: 742110 - DNA, 13 bp, C. elegans
tttgaaacgttat

SEQ ID NO: 742111 - DNA, 13 bp, C. elegans
tttgaaactgaca

SEQ ID NO: 742112 - DNA, 13 bp, C. elegans
tttgaaactgatc

SEQ ID NO: 742113 - DNA, 13 bp, C. elegans
tttgaaactgtag

SEQ ID NO: 742114 - DNA, 13 bp, C. elegans
tttgaaacttcac

SEQ ID NO: 742115 - DNA, 13 bp, C. elegans
tttgaaacttgca

SEQ ID NO: 742116 - DNA, 13 bp, C. elegans
tttgaaacttgct

SEQ ID NO: 742117 - DNA, 13 bp, C. elegans
tttgaaacttggt

SEQ ID NO: 742118 - DNA, 13 bp, C. elegans
tttgaaactttct

SEQ ID NO: 742119 - DNA, 13 bp, C. elegans
tttgaaactttta

SEQ ID NO: 742120 - DNA, 13 bp, C. elegans
tttgaaacttttc

SEQ ID NO: 742121 - DNA, 13 bp, C. elegans
tttgaaacttttt

SEQ ID NO: 742122 - DNA, 13 bp, C. elegans
tttgaaagaaaat

SEQ ID NO: 742123 - DNA, 13 bp, C. elegans
tttgaaagaagaa

SEQ ID NO: 742124 - DNA, 13 bp, C. elegans
tttgaaagaagtt

SEQ ID NO: 742125 - DNA, 13 bp, C. elegans
tttgaaagacatt

SEQ ID NO: 742126 - DNA, 13 bp, C. elegans
tttgaaagagaaa

SEQ ID NO: 742127 - DNA, 13 bp, C. elegans
tttgaaagagcag

SEQ ID NO: 742128 - DNA, 13 bp, C. elegans
tttgaaagatttc

SEQ ID NO: 742129 - DNA, 13 bp, C. elegans
tttgaaagcatat

SEQ ID NO: 742130 - DNA, 13 bp, C. elegans
tttgaaagctcat

SEQ ID NO: 742131 - DNA, 13 bp, C. elegans
tttgaaagctctt

SEQ ID NO: 742132 - DNA, 13 bp, C. elegans
tttgaaaggaaaa

SEQ ID NO: 742133 - DNA, 13 bp, C. elegans
tttgaaaggttat

SEQ ID NO: 742134 - DNA, 13 bp, C. elegans
tttgaaaggtttt

SEQ ID NO: 742135 - DNA, 13 bp, C. elegans
tttgaaagtcaaa

SEQ ID NO: 742136 - DNA, 13 bp, C. elegans
tttgaaagtcgac

SEQ ID NO: 742137 - DNA, 13 bp, C. elegans
tttgaaagtgaaa

SEQ ID NO: 742138 - DNA, 13 bp, C. elegans
tttgaaagtgata

SEQ ID NO: 742139 - DNA, 13 bp, C. elegans
tttgaaagttaaa

SEQ ID NO: 742140 - DNA, 13 bp, C. elegans
tttgaaagttata

SEQ ID NO: 742141 - DNA, 13 bp, C. elegans
tttgaaagttatt

SEQ ID NO: 742142 - DNA, 13 bp, C. elegans
tttgaaagttcaa

SEQ ID NO: 742143 - DNA, 13 bp, C. elegans
tttgaaagtttga

SEQ ID NO: 742144 - DNA, 13 bp, C. elegans
tttgaaataaacc

SEQ ID NO: 742145 - DNA, 13 bp, C. elegans
tttgaaataaagt

SEQ ID NO: 742146 - DNA, 13 bp, C. elegans
tttgaaataagtt

SEQ ID NO: 742147 - DNA, 13 bp, C. elegans
tttgaaataatac

SEQ ID NO: 742148 - DNA, 13 bp, C. elegans
tttgaaataatga

SEQ ID NO: 742149 - DNA, 13 bp, C. elegans
tttgaaatacttt

SEQ ID NO: 742150 - DNA, 13 bp, C. elegans
tttgaaatatctt

SEQ ID NO: 742151 - DNA, 13 bp, C. elegans
tttgaaatattct

SEQ ID NO: 742152 - DNA, 13 bp, C. elegans
tttgaaatattgt

SEQ ID NO: 742153 - DNA, 13 bp, C. elegans
tttgaaatcaaac

SEQ ID NO: 742154 - DNA, 13 bp, C. elegans
tttgaaatcaata

SEQ ID NO: 742155 - DNA, 13 bp, C. elegans
tttgaaatcaatg

SEQ ID NO: 742156 - DNA, 13 bp, C. elegans
tttgaaatcatca

SEQ ID NO: 742157 - DNA, 13 bp, C. elegans
tttgaaatcattg

SEQ ID NO: 742158 - DNA, 13 bp, C. elegans
tttgaaatcgttt

SEQ ID NO: 742159 - DNA, 13 bp, C. elegans
tttgaaatctgaa

SEQ ID NO: 742160 - DNA, 13 bp, C. elegans
tttgaaatcttct

SEQ ID NO: 742161 - DNA, 13 bp, C. elegans
tttgaaatgaaac

SEQ ID NO: 742162 - DNA, 13 bp, C. elegans
tttgaaatgaaat

SEQ ID NO: 742163 - DNA, 13 bp, C. elegans
tttgaaatgagaa

SEQ ID NO: 742164 - DNA, 13 bp, C. elegans
tttgaaatgcaat

SEQ ID NO: 742165 - DNA, 13 bp, C. elegans
tttgaaatgtcaa

SEQ ID NO: 742166 - DNA, 13 bp, C. elegans
tttgaaatgtcat

SEQ ID NO: 742167 - DNA, 13 bp, C. elegans
tttgaaatgttaa

SEQ ID NO: 742168 - DNA, 13 bp, C. elegans
tttgaaatgtttc

SEQ ID NO: 742169 - DNA, 13 bp, C. elegans
tttgaaatgtttg

SEQ ID NO: 742170 - DNA, 13 bp, C. elegans
tttgaaattatca

SEQ ID NO: 742171 - DNA, 13 bp, C. elegans
tttgaaattcccg

SEQ ID NO: 742172 - DNA, 13 bp, C. elegans
tttgaaattcgaa

SEQ ID NO: 742173 - DNA, 13 bp, C. elegans
tttgaaattctcg

SEQ ID NO: 742174 - DNA, 13 bp, C. elegans
tttgaaattctct

SEQ ID NO: 742175 - DNA, 13 bp, C. elegans
tttgaaattcttc

SEQ ID NO: 742176 - DNA, 13 bp, C. elegans
tttgaaattcttt

SEQ ID NO: 742177 - DNA, 13 bp, C. elegans
tttgaaattgaaa

SEQ ID NO: 742178 - DNA, 13 bp, C. elegans
tttgaaattgaat

SEQ ID NO: 742179 - DNA, 13 bp, C. elegans
tttgaaattgata

SEQ ID NO: 742180 - DNA, 13 bp, C. elegans
tttgaaattgttc

SEQ ID NO: 742181 - DNA, 13 bp, C. elegans
tttgaaatttcac

SEQ ID NO: 742182 - DNA, 13 bp, C. elegans
tttgaaatttcca

SEQ ID NO: 742183 - DNA, 13 bp, C. elegans
tttgaaatttctg

SEQ ID NO: 742184 - DNA, 13 bp, C. elegans
tttgaaatttgaa

SEQ ID NO: 742185 - DNA, 13 bp, C. elegans
tttgaaatttgcc

SEQ ID NO: 742186 - DNA, 13 bp, C. elegans
tttgaaatttgga

SEQ ID NO: 742187 - DNA, 13 bp, C. elegans
tttgaacaaaaac

SEQ ID NO: 742188 - DNA, 13 bp, C. elegans
tttgaacaaaaag

SEQ ID NO: 742189 - DNA, 13 bp, C. elegans
tttgaacaaaaat

SEQ ID NO: 742190 - DNA, 13 bp, C. elegans
tttgaacaaatca

SEQ ID NO: 742191 - DNA, 13 bp, C. elegans
tttgaacaaattc

SEQ ID NO: 742192 - DNA, 13 bp, C. elegans
tttgaacaactat

SEQ ID NO: 742193 - DNA, 13 bp, C. elegans
tttgaacaaggaa

SEQ ID NO: 742194 - DNA, 13 bp, C. elegans
tttgaacaatatt

SEQ ID NO: 742195 - DNA, 13 bp, C. elegans
tttgaacaattat

SEQ ID NO: 742196 - DNA, 13 bp, C. elegans
tttgaacatataa

SEQ ID NO: 742197 - DNA, 13 bp, C. elegans
tttgaacattgta

SEQ ID NO: 742198 - DNA, 13 bp, C. elegans
tttgaacatttta

SEQ ID NO: 742199 - DNA, 13 bp, C. elegans
tttgaacattttc

SEQ ID NO: 742200 - DNA, 13 bp, C. elegans
tttgaacattttt

SEQ ID NO: 742201 - DNA, 13 bp, C. elegans
tttgaaccaaaaa

SEQ ID NO: 742202 - DNA, 13 bp, C. elegans
tttgaaccaaatt

SEQ ID NO: 742203 - DNA, 13 bp, C. elegans
tttgaaccgtttg

SEQ ID NO: 742204 - DNA, 13 bp, C. elegans
tttgaacgaaaaa

SEQ ID NO: 742205 - DNA, 13 bp, C. elegans
tttgaacgtttat

SEQ ID NO: 742206 - DNA, 13 bp, C. elegans
tttgaactaaaaa

SEQ ID NO: 742207 - DNA, 13 bp, C. elegans
tttgaactcaaaa

SEQ ID NO: 742208 - DNA, 13 bp, C. elegans
tttgaactcaata

SEQ ID NO: 742209 - DNA, 13 bp, C. elegans
tttgaactcaatt

SEQ ID NO: 742210 - DNA, 13 bp, C. elegans
tttgaactctccc

SEQ ID NO: 742211 - DNA, 13 bp, C. elegans
tttgaactgtttt

SEQ ID NO: 742212 - DNA, 13 bp, C. elegans
tttgaacttccgc

SEQ ID NO: 742213 - DNA, 13 bp, C. elegans
tttgaactttatt

SEQ ID NO: 742214 - DNA, 13 bp, C. elegans
tttgaactttcta

SEQ ID NO: 742215 - DNA, 13 bp, C. elegans
tttgaactttctc

SEQ ID NO: 742216 - DNA, 13 bp, C. elegans
tttgaactttgaa

SEQ ID NO: 742217 - DNA, 13 bp, C. elegans
tttgaactttgca

SEQ ID NO: 742218 - DNA, 13 bp, C. elegans
tttgaactttgga

SEQ ID NO: 742219 - DNA, 13 bp, C. elegans
tttgaacttttat

SEQ ID NO: 742220 - DNA, 13 bp, C. elegans
tttgaacttttca

SEQ ID NO: 742221 - DNA, 13 bp, C. elegans
tttgaacttttga

SEQ ID NO: 742222 - DNA, 13 bp, C. elegans
tttgaactttttc

SEQ ID NO: 742223 - DNA, 13 bp, C. elegans
tttgaactttttg

SEQ ID NO: 742224 - DNA, 13 bp, C. elegans
tttgaagaaaaag

SEQ ID NO: 742225 - DNA, 13 bp, C. elegans
tttgaagaaaact

SEQ ID NO: 742226 - DNA, 13 bp, C. elegans
tttgaagaaaagt

SEQ ID NO: 742227 - DNA, 13 bp, C. elegans
tttgaagaaacat

SEQ ID NO: 742228 - DNA, 13 bp, C. elegans
tttgaagaaacta

SEQ ID NO: 742229 - DNA, 13 bp, C. elegans
tttgaagaaactt

SEQ ID NO: 742230 - DNA, 13 bp, C. elegans
tttgaagaaagat

SEQ ID NO: 742231 - DNA, 13 bp, C. elegans
tttgaagaaagta

SEQ ID NO: 742232 - DNA, 13 bp, C. elegans
tttgaagaaatgt

SEQ ID NO: 742233 - DNA, 13 bp, C. elegans
tttgaagaaattt

SEQ ID NO: 742234 - DNA, 13 bp, C. elegans
tttgaagaaggaa

SEQ ID NO: 742235 - DNA, 13 bp, C. elegans
tttgaagaatttc

SEQ ID NO: 742236 - DNA, 13 bp, C. elegans
tttgaagactaaa

SEQ ID NO: 742237 - DNA, 13 bp, C. elegans
tttgaagagaatt

SEQ ID NO: 742238 - DNA, 13 bp, C. elegans
tttgaagagattt

SEQ ID NO: 742239 - DNA, 13 bp, C. elegans
tttgaagaggaaa

SEQ ID NO: 742240 - DNA, 13 bp, C. elegans
tttgaagagtttg

SEQ ID NO: 742241 - DNA, 13 bp, C. elegans
tttgaagatatga

SEQ ID NO: 742242 - DNA, 13 bp, C. elegans
tttgaagatgttt

SEQ ID NO: 742243 - DNA, 13 bp, C. elegans
tttgaagattaaa

SEQ ID NO: 742244 - DNA, 13 bp, C. elegans
tttgaagattact

SEQ ID NO: 742245 - DNA, 13 bp, C. elegans
tttgaagattgtt

SEQ ID NO: 742246 - DNA, 13 bp, C. elegans
tttgaagatttaa

SEQ ID NO: 742247 - DNA, 13 bp, C. elegans
tttgaagatttct

SEQ ID NO: 742248 - DNA, 13 bp, C. elegans
tttgaagattttc

SEQ ID NO: 742249 - DNA, 13 bp, C. elegans
tttgaagcagaaa

SEQ ID NO: 742250 - DNA, 13 bp, C. elegans
tttgaagcatttt

SEQ ID NO: 742251 - DNA, 13 bp, C. elegans
tttgaagctaaaa

SEQ ID NO: 742252 - DNA, 13 bp, C. elegans
tttgaagctgaaa

SEQ ID NO: 742253 - DNA, 13 bp, C. elegans
tttgaagctttca

SEQ ID NO: 742254 - DNA, 13 bp, C. elegans
tttgaaggaaaca

SEQ ID NO: 742255 - DNA, 13 bp, C. elegans
tttgaaggaaatt

SEQ ID NO: 742256 - DNA, 13 bp, C. elegans
tttgaaggatttt

SEQ ID NO: 742257 - DNA, 13 bp, C. elegans
tttgaaggcgcat

SEQ ID NO: 742258 - DNA, 13 bp, C. elegans
tttgaaggtagtc

SEQ ID NO: 742259 - DNA, 13 bp, C. elegans
tttgaaggtttta

SEQ ID NO: 742260 - DNA, 13 bp, C. elegans
tttgaagtcaaaa

SEQ ID NO: 742261 - DNA, 13 bp, C. elegans
tttgaagtgaaaa

SEQ ID NO: 742262 - DNA, 13 bp, C. elegans
tttgaagttaaaa

SEQ ID NO: 742263 - DNA, 13 bp, C. elegans
tttgaagttaaat

SEQ ID NO: 742264 - DNA, 13 bp, C. elegans
tttgaagttacag

SEQ ID NO: 742265 - DNA, 13 bp, C. elegans
tttgaagttcaaa

SEQ ID NO: 742266 - DNA, 13 bp, C. elegans
tttgaagttcccg

SEQ ID NO: 742267 - DNA, 13 bp, C. elegans
tttgaagttgaga

SEQ ID NO: 742268 - DNA, 13 bp, C. elegans
tttgaagttgatt

SEQ ID NO: 742269 - DNA, 13 bp, C. elegans
tttgaagttgcat

SEQ ID NO: 742270 - DNA, 13 bp, C. elegans
tttgaagttggtg

SEQ ID NO: 742271 - DNA, 14 bp, C. elegans
tttgaagtttaaat

SEQ ID NO: 742272 - DNA, 13 bp, C. elegans
tttgaagtttgaa

SEQ ID NO: 742273 - DNA, 13 bp, C. elegans
tttgaagtttggc

SEQ ID NO: 742274 - DNA, 13 bp, C. elegans
tttgaagttttaa

SEQ ID NO: 742275 - DNA, 13 bp, C. elegans
tttgaagttttca

SEQ ID NO: 742276 - DNA, 13 bp, C. elegans
tttgaagtttttc

SEQ ID NO: 742277 - DNA, 13 bp, C. elegans
tttgaataaaaca

SEQ ID NO: 742278 - DNA, 13 bp, C. elegans
tttgaataaagaa

SEQ ID NO: 742279 - DNA, 13 bp, C. elegans
tttgaataaagtt

SEQ ID NO: 742280 - DNA, 13 bp, C. elegans
tttgaataaattg

SEQ ID NO: 742281 - DNA, 13 bp, C. elegans
tttgaataactta

SEQ ID NO: 742282 - DNA, 13 bp, C. elegans
tttgaatacaaaa

SEQ ID NO: 742283 - DNA, 13 bp, C. elegans
tttgaatacttta

SEQ ID NO: 742284 - DNA, 13 bp, C. elegans
tttgaatactttt

SEQ ID NO: 742285 - DNA, 13 bp, C. elegans
tttgaatagtttc

SEQ ID NO: 742286 - DNA, 13 bp, C. elegans
tttgaatatatca

SEQ ID NO: 742287 - DNA, 13 bp, C. elegans
tttgaatatatct

SEQ ID NO: 742288 - DNA, 13 bp, C. elegans
tttgaatatattg

SEQ ID NO: 742289 - DNA, 13 bp, C. elegans
tttgaatatcaaa

SEQ ID NO: 742290 - DNA, 13 bp, C. elegans
tttgaatatccaa

SEQ ID NO: 742291 - DNA, 13 bp, C. elegans
tttgaatattcaa

SEQ ID NO: 742292 - DNA, 13 bp, C. elegans
tttgaatattccc

SEQ ID NO: 742293 - DNA, 13 bp, C. elegans
tttgaatattgaa

SEQ ID NO: 742294 - DNA, 13 bp, C. elegans
tttgaatatttca

SEQ ID NO: 742295 - DNA, 13 bp, C. elegans
tttgaatattttc

SEQ ID NO: 742296 - DNA, 13 bp, C. elegans
tttgaatcaaaac

SEQ ID NO: 742297 - DNA, 13 bp, C. elegans
tttgaatcattat

SEQ ID NO: 742298 - DNA, 13 bp, C. elegans
tttgaatccaaaa

SEQ ID NO: 742299 - DNA, 13 bp, C. elegans
tttgaatcggaaa

SEQ ID NO: 742300 - DNA, 13 bp, C. elegans
tttgaatctaaat

SEQ ID NO: 742301 - DNA, 13 bp, C. elegans
tttgaatctcccg

SEQ ID NO: 742302 - DNA, 13 bp, C. elegans
tttgaatctggaa

SEQ ID NO: 742303 - DNA, 13 bp, C. elegans
tttgaatgaaatc

SEQ ID NO: 742304 - DNA, 13 bp, C. elegans
tttgaatgaagaa

SEQ ID NO: 742305 - DNA, 13 bp, C. elegans
tttgaatgaatat

SEQ ID NO: 742306 - DNA, 13 bp, C. elegans
tttgaatgaatgt

SEQ ID NO: 742307 - DNA, 13 bp, C. elegans
tttgaatgagttt

SEQ ID NO: 742308 - DNA, 13 bp, C. elegans
tttgaatgataaa

SEQ ID NO: 742309 - DNA, 13 bp, C. elegans
tttgaatgcaaaa

SEQ ID NO: 742310 - DNA, 13 bp, C. elegans
tttgaatgcaatt

SEQ ID NO: 742311 - DNA, 13 bp, C. elegans
tttgaatgctttt

SEQ ID NO: 742312 - DNA, 13 bp, C. elegans
tttgaatgtaaaa

SEQ ID NO: 742313 - DNA, 13 bp, C. elegans
tttgaatgtcaaa

SEQ ID NO: 742314 - DNA, 13 bp, C. elegans
tttgaatgttgaa

SEQ ID NO: 742315 - DNA, 13 bp, C. elegans
tttgaatgtttga

SEQ ID NO: 742316 - DNA, 13 bp, C. elegans
tttgaatgttttc

SEQ ID NO: 742317 - DNA, 13 bp, C. elegans
tttgaattacata

SEQ ID NO: 742318 - DNA, 13 bp, C. elegans
tttgaattaccgc

SEQ ID NO: 742319 - DNA, 13 bp, C. elegans
tttgaattactgt

SEQ ID NO: 742320 - DNA, 13 bp, C. elegans
tttgaattagaaa

SEQ ID NO: 742321 - DNA, 13 bp, C. elegans
tttgaattcaaaa

SEQ ID NO: 742322 - DNA, 13 bp, C. elegans
tttgaattcaatt

SEQ ID NO: 742323 - DNA, 13 bp, C. elegans
tttgaattcagaa

SEQ ID NO: 742324 - DNA, 13 bp, C. elegans
tttgaattcataa

SEQ ID NO: 742325 - DNA, 13 bp, C. elegans
tttgaattcattc

SEQ ID NO: 742326 - DNA, 13 bp, C. elegans
tttgaattcattt

SEQ ID NO: 742327 - DNA, 13 bp, C. elegans
tttgaattcccca

SEQ ID NO: 742328 - DNA, 13 bp, C. elegans
tttgaattcctgc

SEQ ID NO: 742329 - DNA, 13 bp, C. elegans
tttgaattctgtt

SEQ ID NO: 742330 - DNA, 13 bp, C. elegans
tttgaattcttaa

SEQ ID NO: 742331 - DNA, 13 bp, C. elegans
tttgaattgaaaa

SEQ ID NO: 742332 - DNA, 13 bp, C. elegans
tttgaattgatgt

SEQ ID NO: 742333 - DNA, 13 bp, C. elegans
tttgaattgccaa

SEQ ID NO: 742334 - DNA, 13 bp, C. elegans
tttgaatttaatg

SEQ ID NO: 742335 - DNA, 13 bp, C. elegans
tttgaatttattc

SEQ ID NO: 742336 - DNA, 13 bp, C. elegans
tttgaatttcaaa

SEQ ID NO: 742337 - DNA, 13 bp, C. elegans
tttgaatttcaat

SEQ ID NO: 742338 - DNA, 13 bp, C. elegans
tttgaatttcatg

SEQ ID NO: 742339 - DNA, 13 bp, C. elegans
tttgaatttccaa

SEQ ID NO: 742340 - DNA, 13 bp, C. elegans
tttgaatttcctg

SEQ ID NO: 742341 - DNA, 13 bp, C. elegans
tttgaatttctat

SEQ ID NO: 742342 - DNA, 13 bp, C. elegans
tttgaatttctgc

SEQ ID NO: 742343 - DNA, 13 bp, C. elegans
tttgaatttctgg

SEQ ID NO: 742344 - DNA, 13 bp, C. elegans
tttgaatttgaaa

SEQ ID NO: 742345 - DNA, 13 bp, C. elegans
tttgaatttgacg

SEQ ID NO: 742346 - DNA, 13 bp, C. elegans
tttgaattttaac

SEQ ID NO: 742347 - DNA, 13 bp, C. elegans
tttgaattttaag

SEQ ID NO: 742348 - DNA, 13 bp, C. elegans
tttgaattttaca

SEQ ID NO: 742349 - DNA, 13 bp, C. elegans
tttgaattttctg

SEQ ID NO: 742350 - DNA, 13 bp, C. elegans
tttgacaaaaaaa

SEQ ID NO: 742351 - DNA, 13 bp, C. elegans
tttgacaaaaatt

SEQ ID NO: 742352 - DNA, 13 bp, C. elegans
tttgacaaaacaa

SEQ ID NO: 742353 - DNA, 13 bp, C. elegans
tttgacaaagttt

SEQ ID NO: 742354 - DNA, 13 bp, C. elegans
tttgacaaatgaa

SEQ ID NO: 742355 - DNA, 13 bp, C. elegans
tttgacaaatttc

SEQ ID NO: 742356 - DNA, 13 bp, C. elegans
tttgacaacaatt

SEQ ID NO: 742357 - DNA, 13 bp, C. elegans
tttgacaagaaat

SEQ ID NO: 742358 - DNA, 13 bp, C. elegans
tttgacaatacaa

SEQ ID NO: 742359 - DNA, 13 bp, C. elegans
tttgacaatgaaa

SEQ ID NO: 742360 - DNA, 13 bp, C. elegans
tttgacaatgttt

SEQ ID NO: 742361 - DNA, 13 bp, C. elegans
tttgacaattgaa

SEQ ID NO: 742362 - DNA, 13 bp, C. elegans
tttgacaatttct

SEQ ID NO: 742363 - DNA, 13 bp, C. elegans
tttgacaattttt

SEQ ID NO: 742364 - DNA, 13 bp, C. elegans
tttgacacaaaat

SEQ ID NO: 742365 - DNA, 13 bp, C. elegans
tttgacacatttt

SEQ ID NO: 742366 - DNA, 13 bp, C. elegans
tttgacactttct

SEQ ID NO: 742367 - DNA, 13 bp, C. elegans
tttgacacttttc

SEQ ID NO: 742368 - DNA, 13 bp, C. elegans
tttgacagaaatt

SEQ ID NO: 742369 - DNA, 13 bp, C. elegans
tttgacagtgaat

SEQ ID NO: 742370 - DNA, 13 bp, C. elegans
tttgacagtgttg

SEQ ID NO: 742371 - DNA, 13 bp, C. elegans
tttgacagtttct

SEQ ID NO: 742372 - DNA, 13 bp, C. elegans
tttgacatgtttt

SEQ ID NO: 742373 - DNA, 13 bp, C. elegans
tttgacattttgc

SEQ ID NO: 742374 - DNA, 13 bp, C. elegans
tttgacattttta

SEQ ID NO: 742375 - DNA, 13 bp, C. elegans
tttgacatttttc

SEQ ID NO: 742376 - DNA, 13 bp, C. elegans
tttgaccaacttg

SEQ ID NO: 742377 - DNA, 13 bp, C. elegans
tttgaccaacttt

SEQ ID NO: 742378 - DNA, 13 bp, C. elegans
tttgaccatttta

SEQ ID NO: 742379 - DNA, 13 bp, C. elegans
tttgaccattttc

SEQ ID NO: 742380 - DNA, 13 bp, C. elegans
tttgacccccata

SEQ ID NO: 742381 - DNA, 13 bp, C. elegans
tttgacccgaaaa

SEQ ID NO: 742382 - DNA, 13 bp, C. elegans
tttgaccgttttt

SEQ ID NO: 742383 - DNA, 13 bp, C. elegans
tttgaccttaaaa

SEQ ID NO: 742384 - DNA, 13 bp, C. elegans
tttgacgatttgc

SEQ ID NO: 742385 - DNA, 13 bp, C. elegans
tttgacgcatttt

SEQ ID NO: 742386 - DNA, 13 bp, C. elegans
tttgacggaaatt

SEQ ID NO: 742387 - DNA, 13 bp, C. elegans
tttgacggaattt

SEQ ID NO: 742388 - DNA, 13 bp, C. elegans
tttgacgggaaaa

SEQ ID NO: 742389 - DNA, 13 bp, C. elegans
tttgacggttttt

SEQ ID NO: 742390 - DNA, 13 bp, C. elegans
tttgacgtatttt

SEQ ID NO: 742391 - DNA, 13 bp, C. elegans
tttgactacctta

SEQ ID NO: 742392 - DNA, 13 bp, C. elegans
tttgactagaaaa

SEQ ID NO: 742393 - DNA, 13 bp, C. elegans
tttgactatttca

SEQ ID NO: 742394 - DNA, 13 bp, C. elegans
tttgactcaattt

SEQ ID NO: 742395 - DNA, 13 bp, C. elegans
tttgactgaaact

SEQ ID NO: 742396 - DNA, 13 bp, C. elegans
tttgactgaaagt

SEQ ID NO: 742397 - DNA, 13 bp, C. elegans
tttgactgatgat

SEQ ID NO: 742398 - DNA, 13 bp, C. elegans
tttgactgtgaat

SEQ ID NO: 742399 - DNA, 13 bp, C. elegans
tttgacttaaaat

SEQ ID NO: 742400 - DNA, 13 bp, C. elegans
tttgacttggaaa

SEQ ID NO: 742401 - DNA, 13 bp, C. elegans
tttgactttaatt

SEQ ID NO: 742402 - DNA, 13 bp, C. elegans
tttgactttgatt

SEQ ID NO: 742403 - DNA, 13 bp, C. elegans
tttgacttttaaa

SEQ ID NO: 742404 - DNA, 13 bp, C. elegans
tttgacttttcca

SEQ ID NO: 742405 - DNA, 13 bp, C. elegans
tttgagaaaaagc

SEQ ID NO: 742406 - DNA, 13 bp, C. elegans
tttgagaaaaagg

SEQ ID NO: 742407 - DNA, 13 bp, C. elegans
tttgagaaaaagt

SEQ ID NO: 742408 - DNA, 13 bp, C. elegans
tttgagaaaaatg

SEQ ID NO: 742409 - DNA, 13 bp, C. elegans
tttgagaaaacaa

SEQ ID NO: 742410 - DNA, 13 bp, C. elegans
tttgagaaaacta

SEQ ID NO: 742411 - DNA, 13 bp, C. elegans
tttgagaaaagaa

SEQ ID NO: 742412 - DNA, 13 bp, C. elegans
tttgagaaaagtt

SEQ ID NO: 742413 - DNA, 13 bp, C. elegans
tttgagaaaataa

SEQ ID NO: 742414 - DNA, 14 bp, C. elegans
tttgagaaaataat

SEQ ID NO: 742415 - DNA, 13 bp, C. elegans
tttgagaaaatat

SEQ ID NO: 742416 - DNA, 13 bp, C. elegans
tttgagaaaatcg

SEQ ID NO: 742417 - DNA, 13 bp, C. elegans
tttgagaaaatta

SEQ ID NO: 742418 - DNA, 13 bp, C. elegans
tttgagaaaattg

SEQ ID NO: 742419 - DNA, 13 bp, C. elegans
tttgagaaactaa

SEQ ID NO: 742420 - DNA, 13 bp, C. elegans
tttgagaaataca

SEQ ID NO: 742421 - DNA, 13 bp, C. elegans
tttgagaaatttc

SEQ ID NO: 742422 - DNA, 13 bp, C. elegans
tttgagaaatttt

SEQ ID NO: 742423 - DNA, 13 bp, C. elegans
tttgagaacaatt

SEQ ID NO: 742424 - DNA, 13 bp, C. elegans
tttgagaactgtt

SEQ ID NO: 742425 - DNA, 13 bp, C. elegans
tttgagaagaaaa

SEQ ID NO: 742426 - DNA, 13 bp, C. elegans
tttgagaagtatt

SEQ ID NO: 742427 - DNA, 13 bp, C. elegans
tttgagaatacaa

SEQ ID NO: 742428 - DNA, 13 bp, C. elegans
tttgagaatcaag

SEQ ID NO: 742429 - DNA, 13 bp, C. elegans
tttgagaattctg

SEQ ID NO: 742430 - DNA, 13 bp, C. elegans
tttgagaattttc

SEQ ID NO: 742431 - DNA, 13 bp, C. elegans
tttgagagaaaag

SEQ ID NO: 742432 - DNA, 13 bp, C. elegans
tttgagagaagaa

SEQ ID NO: 742433 - DNA, 13 bp, C. elegans
tttgagagaagtt

SEQ ID NO: 742434 - DNA, 13 bp, C. elegans
tttgagagagttt

SEQ ID NO: 742435 - DNA, 13 bp, C. elegans
tttgagaggaaaa

SEQ ID NO: 742436 - DNA, 13 bp, C. elegans
tttgagaggtttt

SEQ ID NO: 742437 - DNA, 13 bp, C. elegans
tttgagagttttg

SEQ ID NO: 742438 - DNA, 13 bp, C. elegans
tttgagatcacga

SEQ ID NO: 742439 - DNA, 13 bp, C. elegans
tttgagattataa

SEQ ID NO: 742440 - DNA, 13 bp, C. elegans
tttgagattgaaa

SEQ ID NO: 742441 - DNA, 13 bp, C. elegans
tttgagatttata

SEQ ID NO: 742442 - DNA, 13 bp, C. elegans
tttgagatttcag

SEQ ID NO: 742443 - DNA, 13 bp, C. elegans
tttgagatttgag

SEQ ID NO: 742444 - DNA, 13 bp, C. elegans
tttgagattttca

SEQ ID NO: 742445 - DNA, 13 bp, C. elegans
tttgagcaaaaat

SEQ ID NO: 742446 - DNA, 13 bp, C. elegans
tttgagcaaaatt

SEQ ID NO: 742447 - DNA, 13 bp, C. elegans
tttgagcaaactt

SEQ ID NO: 742448 - DNA, 13 bp, C. elegans
tttgagcactttt

SEQ ID NO: 742449 - DNA, 13 bp, C. elegans
tttgagcagaaat

SEQ ID NO: 742450 - DNA, 13 bp, C. elegans
tttgagcatttca

SEQ ID NO: 742451 - DNA, 13 bp, C. elegans
tttgagcatttta

SEQ ID NO: 742452 - DNA, 13 bp, C. elegans
tttgagcattttg

SEQ ID NO: 742453 - DNA, 13 bp, C. elegans
tttgagccaccat

SEQ ID NO: 742454 - DNA, 13 bp, C. elegans
tttgagcctattt

SEQ ID NO: 742455 - DNA, 13 bp, C. elegans
tttgagcggaaaa

SEQ ID NO: 742456 - DNA, 13 bp, C. elegans
tttgagctcaaaa

SEQ ID NO: 742457 - DNA, 13 bp, C. elegans
tttgagctctttt

SEQ ID NO: 742458 - DNA, 13 bp, C. elegans
tttgagcttcaaa

SEQ ID NO: 742459 - DNA, 13 bp, C. elegans
tttgagcttcatt

SEQ ID NO: 742460 - DNA, 13 bp, C. elegans
tttgagcttgaaa

SEQ ID NO: 742461 - DNA, 13 bp, C. elegans
tttgaggaaaatt

SEQ ID NO: 742462 - DNA, 13 bp, C. elegans
tttgaggactttt

SEQ ID NO: 742463 - DNA, 13 bp, C. elegans
tttgaggattttg

SEQ ID NO: 742464 - DNA, 13 bp, C. elegans
tttgagtaatttc

SEQ ID NO: 742465 - DNA, 13 bp, C. elegans
tttgagtacaaat

SEQ ID NO: 742466 - DNA, 13 bp, C. elegans
tttgagtattaaa

SEQ ID NO: 742467 - DNA, 13 bp, C. elegans
tttgagtatttct

SEQ ID NO: 742468 - DNA, 13 bp, C. elegans
tttgagtattttc

SEQ ID NO: 742469 - DNA, 13 bp, C. elegans
tttgagtcgaaat

SEQ ID NO: 742470 - DNA, 13 bp, C. elegans
tttgagtgaaaat

SEQ ID NO: 742471 - DNA, 13 bp, C. elegans
tttgagtgcattt

SEQ ID NO: 742472 - DNA, 13 bp, C. elegans
tttgagtgtaaat

SEQ ID NO: 742473 - DNA, 13 bp, C. elegans
tttgagtgtagac

SEQ ID NO: 742474 - DNA, 13 bp, C. elegans
tttgagtgttttc

SEQ ID NO: 742475 - DNA, 13 bp, C. elegans
tttgagttaaaaa

SEQ ID NO: 742476 - DNA, 13 bp, C. elegans
tttgagttaaaac

SEQ ID NO: 742477 - DNA, 13 bp, C. elegans
tttgagttcaaaa

SEQ ID NO: 742478 - DNA, 13 bp, C. elegans
tttgagttgaaaa

SEQ ID NO: 742479 - DNA, 13 bp, C. elegans
tttgagttggaaa

SEQ ID NO: 742480 - DNA, 13 bp, C. elegans
tttgagtttaaaa

SEQ ID NO: 742481 - DNA, 13 bp, C. elegans
tttgagtttcaaa

SEQ ID NO: 742482 - DNA, 13 bp, C. elegans
tttgagtttcaat

SEQ ID NO: 742483 - DNA, 13 bp, C. elegans
tttgagtttgaaa

SEQ ID NO: 742484 - DNA, 13 bp, C. elegans
tttgagttttcat

SEQ ID NO: 742485 - DNA, 13 bp, C. elegans
tttgagttttccc

SEQ ID NO: 742486 - DNA, 13 bp, C. elegans
tttgagtttttac

SEQ ID NO: 742487 - DNA, 13 bp, C. elegans
tttgataaaaagt

SEQ ID NO: 742488 - DNA, 13 bp, C. elegans
tttgataaaacaa

SEQ ID NO: 742489 - DNA, 13 bp, C. elegans
tttgataaaagtg

SEQ ID NO: 742490 - DNA, 13 bp, C. elegans
tttgataaaatca

SEQ ID NO: 742491 - DNA, 13 bp, C. elegans
tttgataaaatcg

SEQ ID NO: 742492 - DNA, 13 bp, C. elegans
tttgataaagttt

SEQ ID NO: 742493 - DNA, 13 bp, C. elegans
tttgataaatgat

SEQ ID NO: 742494 - DNA, 13 bp, C. elegans
tttgataaatgtt

SEQ ID NO: 742495 - DNA, 13 bp, C. elegans
tttgataaattcc

SEQ ID NO: 742496 - DNA, 13 bp, C. elegans
tttgataactttg

SEQ ID NO: 742497 - DNA, 13 bp, C. elegans
tttgataatattg

SEQ ID NO: 742498 - DNA, 13 bp, C. elegans
tttgataattgat

SEQ ID NO: 742499 - DNA, 13 bp, C. elegans
tttgataatttac

SEQ ID NO: 742500 - DNA, 13 bp, C. elegans
tttgataatttca

SEQ ID NO: 742501 - DNA, 13 bp, C. elegans
tttgatacaataa

SEQ ID NO: 742502 - DNA, 13 bp, C. elegans
tttgatacacttt

SEQ ID NO: 742503 - DNA, 13 bp, C. elegans
tttgataccaaaa

SEQ ID NO: 742504 - DNA, 13 bp, C. elegans
tttgataccttca

SEQ ID NO: 742505 - DNA, 13 bp, C. elegans
tttgatagaaaaa

SEQ ID NO: 742506 - DNA, 13 bp, C. elegans
tttgatagctcta

SEQ ID NO: 742507 - DNA, 13 bp, C. elegans
tttgatagctctt

SEQ ID NO: 742508 - DNA, 13 bp, C. elegans
tttgataggaaat

SEQ ID NO: 742509 - DNA, 13 bp, C. elegans
tttgatatcaaac

SEQ ID NO: 742510 - DNA, 13 bp, C. elegans
tttgatatcaaat

SEQ ID NO: 742511 - DNA, 13 bp, C. elegans
tttgatatcactt

SEQ ID NO: 742512 - DNA, 13 bp, C. elegans
tttgatatcattt

SEQ ID NO: 742513 - DNA, 13 bp, C. elegans
tttgatatctcca

SEQ ID NO: 742514 - DNA, 13 bp, C. elegans
tttgatatcttca

SEQ ID NO: 742515 - DNA, 13 bp, C. elegans
tttgatattgaaa

SEQ ID NO: 742516 - DNA, 13 bp, C. elegans
tttgatatttcaa

SEQ ID NO: 742517 - DNA, 13 bp, C. elegans
tttgatatttcag

SEQ ID NO: 742518 - DNA, 13 bp, C. elegans
tttgatatttcta

SEQ ID NO: 742519 - DNA, 13 bp, C. elegans
tttgatatttctg

SEQ ID NO: 742520 - DNA, 13 bp, C. elegans
tttgatatttgga

SEQ ID NO: 742521 - DNA, 13 bp, C. elegans
tttgatattttca

SEQ ID NO: 742522 - DNA, 13 bp, C. elegans
tttgatcaaaact

SEQ ID NO: 742523 - DNA, 13 bp, C. elegans
tttgatcaaatca

SEQ ID NO: 742524 - DNA, 13 bp, C. elegans
tttgatcaaatta

SEQ ID NO: 742525 - DNA, 13 bp, C. elegans
tttgatcaaattt

SEQ ID NO: 742526 - DNA, 13 bp, C. elegans
tttgatcaagaaa

SEQ ID NO: 742527 - DNA, 13 bp, C. elegans
tttgatcaatatt

SEQ ID NO: 742528 - DNA, 13 bp, C. elegans
tttgatcaatttt

SEQ ID NO: 742529 - DNA, 13 bp, C. elegans
tttgatcatttga

SEQ ID NO: 742530 - DNA, 13 bp, C. elegans
tttgatcatttta

SEQ ID NO: 742531 - DNA, 13 bp, C. elegans
tttgatccaaaaa

SEQ ID NO: 742532 - DNA, 13 bp, C. elegans
tttgatccaaaat

SEQ ID NO: 742533 - DNA, 13 bp, C. elegans
tttgatccaaatt

SEQ ID NO: 742534 - DNA, 13 bp, C. elegans
tttgatcctattc

SEQ ID NO: 742535 - DNA, 13 bp, C. elegans
tttgatcgaaaaa

SEQ ID NO: 742536 - DNA, 13 bp, C. elegans
tttgatcgatttt

SEQ ID NO: 742537 - DNA, 13 bp, C. elegans
tttgatctacaca

SEQ ID NO: 742538 - DNA, 13 bp, C. elegans
tttgatctacaga

SEQ ID NO: 742539 - DNA, 13 bp, C. elegans
tttgatctaccaa

SEQ ID NO: 742540 - DNA, 13 bp, C. elegans
tttgatctacctg

SEQ ID NO: 742541 - DNA, 13 bp, C. elegans
tttgatctacgaa

SEQ ID NO: 742542 - DNA, 13 bp, C. elegans
tttgatctacttt

SEQ ID NO: 742543 - DNA, 13 bp, C. elegans
tttgatctcattt

SEQ ID NO: 742544 - DNA, 13 bp, C. elegans
tttgatctctgat

SEQ ID NO: 742545 - DNA, 13 bp, C. elegans
tttgatctgaaca

SEQ ID NO: 742546 - DNA, 13 bp, C. elegans
tttgatcttgaaa

SEQ ID NO: 742547 - DNA, 13 bp, C. elegans
tttgatgaaaatc

SEQ ID NO: 742548 - DNA, 13 bp, C. elegans
tttgatgaaatgt

SEQ ID NO: 742549 - DNA, 13 bp, C. elegans
tttgatgaaatta

SEQ ID NO: 742550 - DNA, 13 bp, C. elegans
tttgatgaatata

SEQ ID NO: 742551 - DNA, 13 bp, C. elegans
tttgatgaatttc

SEQ ID NO: 742552 - DNA, 13 bp, C. elegans
tttgatgacaatt

SEQ ID NO: 742553 - DNA, 13 bp, C. elegans
tttgatgacattt

SEQ ID NO: 742554 - DNA, 13 bp, C. elegans
tttgatgactttt

SEQ ID NO: 742555 - DNA, 13 bp, C. elegans
tttgatgagaaaa

SEQ ID NO: 742556 - DNA, 13 bp, C. elegans
tttgatgatgatg

SEQ ID NO: 742557 - DNA, 13 bp, C. elegans
tttgatgatttga

SEQ ID NO: 742558 - DNA, 13 bp, C. elegans
tttgatgcaaaac

SEQ ID NO: 742559 - DNA, 13 bp, C. elegans
tttgatgcaccat

SEQ ID NO: 742560 - DNA, 13 bp, C. elegans
tttgatgcatttt

SEQ ID NO: 742561 - DNA, 13 bp, C. elegans
tttgatgctgaaa

SEQ ID NO: 742562 - DNA, 13 bp, C. elegans
tttgatggaaatt

SEQ ID NO: 742563 - DNA, 13 bp, C. elegans
tttgatggaatat

SEQ ID NO: 742564 - DNA, 13 bp, C. elegans
tttgatggaatca

SEQ ID NO: 742565 - DNA, 13 bp, C. elegans
tttgatgggaaaa

SEQ ID NO: 742566 - DNA, 13 bp, C. elegans
tttgatgtgaaaa

SEQ ID NO: 742567 - DNA, 13 bp, C. elegans
tttgatgtttcat

SEQ ID NO: 742568 - DNA, 13 bp, C. elegans
tttgatgttttca

SEQ ID NO: 742569 - DNA, 13 bp, C. elegans
tttgatgttttcg

SEQ ID NO: 742570 - DNA, 13 bp, C. elegans
tttgattaaaaca

SEQ ID NO: 742571 - DNA, 13 bp, C. elegans
tttgattacaaat

SEQ ID NO: 742572 - DNA, 13 bp, C. elegans
tttgattagaaaa

SEQ ID NO: 742573 - DNA, 13 bp, C. elegans
tttgattatttca

SEQ ID NO: 742574 - DNA, 13 bp, C. elegans
tttgattcaaaaa

SEQ ID NO: 742575 - DNA, 13 bp, C. elegans
tttgattcaaaat

SEQ ID NO: 742576 - DNA, 13 bp, C. elegans
tttgattcaaatt

SEQ ID NO: 742577 - DNA, 13 bp, C. elegans
tttgattcaataa

SEQ ID NO: 742578 - DNA, 13 bp, C. elegans
tttgattcaattt

SEQ ID NO: 742579 - DNA, 13 bp, C. elegans
tttgattcataat

SEQ ID NO: 742580 - DNA, 13 bp, C. elegans
tttgattcatttc

SEQ ID NO: 742581 - DNA, 13 bp, C. elegans
tttgattccaatt

SEQ ID NO: 742582 - DNA, 13 bp, C. elegans
tttgattcgaaat

SEQ ID NO: 742583 - DNA, 13 bp, C. elegans
tttgattcgattt

SEQ ID NO: 742584 - DNA, 13 bp, C. elegans
tttgattctaaaa

SEQ ID NO: 742585 - DNA, 13 bp, C. elegans
tttgattctgaat

SEQ ID NO: 742586 - DNA, 13 bp, C. elegans
tttgattcttcag

SEQ ID NO: 742587 - DNA, 13 bp, C. elegans
tttgattgaatat

SEQ ID NO: 742588 - DNA, 13 bp, C. elegans
tttgattgagaaa

SEQ ID NO: 742589 - DNA, 13 bp, C. elegans
tttgattgagagt

SEQ ID NO: 742590 - DNA, 13 bp, C. elegans
tttgattgtaaat

SEQ ID NO: 742591 - DNA, 13 bp, C. elegans
tttgatttaagta

SEQ ID NO: 742592 - DNA, 13 bp, C. elegans
tttgatttcaaaa

SEQ ID NO: 742593 - DNA, 13 bp, C. elegans
tttgatttcagtt

SEQ ID NO: 742594 - DNA, 13 bp, C. elegans
tttgatttcatat

SEQ ID NO: 742595 - DNA, 13 bp, C. elegans
tttgatttcatga

SEQ ID NO: 742596 - DNA, 13 bp, C. elegans
tttgatttgaaaa

SEQ ID NO: 742597 - DNA, 13 bp, C. elegans
tttgatttgaaat

SEQ ID NO: 742598 - DNA, 13 bp, C. elegans
tttgatttgaatc

SEQ ID NO: 742599 - DNA, 13 bp, C. elegans
tttgatttgatct

SEQ ID NO: 742600 - DNA, 13 bp, C. elegans
tttgatttgcaaa

SEQ ID NO: 742601 - DNA, 13 bp, C. elegans
tttgatttgtaaa

SEQ ID NO: 742602 - DNA, 13 bp, C. elegans
tttgattttcaac

SEQ ID NO: 742603 - DNA, 13 bp, C. elegans
tttgattttcaat

SEQ ID NO: 742604 - DNA, 13 bp, C. elegans
tttgattttcata

SEQ ID NO: 742605 - DNA, 13 bp, C. elegans
tttgattttccgt

SEQ ID NO: 742606 - DNA, 13 bp, C. elegans
tttgattttcgaa

SEQ ID NO: 742607 - DNA, 13 bp, C. elegans
tttgattttcgac

SEQ ID NO: 742608 - DNA, 13 bp, C. elegans
tttgattttcgtc

SEQ ID NO: 742609 - DNA, 13 bp, C. elegans
tttgattttctca

SEQ ID NO: 742610 - DNA, 13 bp, C. elegans
tttgattttgaca

SEQ ID NO: 742611 - DNA, 13 bp, C. elegans
tttgattttggca

SEQ ID NO: 742612 - DNA, 13 bp, C. elegans
tttgatttttaca

SEQ ID NO: 742613 - DNA, 13 bp, C. elegans
tttgatttttcag

SEQ ID NO: 742614 - DNA, 13 bp, C. elegans
tttgatttttccc

SEQ ID NO: 742615 - DNA, 13 bp, C. elegans
tttgatttttccg

SEQ ID NO: 742616 - DNA, 13 bp, C. elegans
tttgcaaaaaaaa

SEQ ID NO: 742617 - DNA, 13 bp, C. elegans
tttgcaaaaacca

SEQ ID NO: 742618 - DNA, 13 bp, C. elegans
tttgcaaaaagtg

SEQ ID NO: 742619 - DNA, 13 bp, C. elegans
tttgcaaaaattt

SEQ ID NO: 742620 - DNA, 13 bp, C. elegans
tttgcaaaacatc

SEQ ID NO: 742621 - DNA, 13 bp, C. elegans
tttgcaaaacatt

SEQ ID NO: 742622 - DNA, 13 bp, C. elegans
tttgcaaaactat

SEQ ID NO: 742623 - DNA, 13 bp, C. elegans
tttgcaaaacttt

SEQ ID NO: 742624 - DNA, 13 bp, C. elegans
tttgcaaaagaaa

SEQ ID NO: 742625 - DNA, 13 bp, C. elegans
tttgcaaaagtaa

SEQ ID NO: 742626 - DNA, 13 bp, C. elegans
tttgcaaaatatc

SEQ ID NO: 742627 - DNA, 13 bp, C. elegans
tttgcaaaatctc

SEQ ID NO: 742628 - DNA, 13 bp, C. elegans
tttgcaaaattag

SEQ ID NO: 742629 - DNA, 13 bp, C. elegans
tttgcaaaattct

SEQ ID NO: 742630 - DNA, 13 bp, C. elegans
tttgcaaaattga

SEQ ID NO: 742631 - DNA, 13 bp, C. elegans
tttgcaaaatttc

SEQ ID NO: 742632 - DNA, 13 bp, C. elegans
tttgcaaacaatt

SEQ ID NO: 742633 - DNA, 13 bp, C. elegans
tttgcaaacttct

SEQ ID NO: 742634 - DNA, 13 bp, C. elegans
tttgcaaactttt

SEQ ID NO: 742635 - DNA, 13 bp, C. elegans
tttgcaaagaaaa

SEQ ID NO: 742636 - DNA, 13 bp, C. elegans
tttgcaaagtttg

SEQ ID NO: 742637 - DNA, 13 bp, C. elegans
tttgcaaagtttt

SEQ ID NO: 742638 - DNA, 13 bp, C. elegans
tttgcaaataaaa

SEQ ID NO: 742639 - DNA, 13 bp, C. elegans
tttgcaaataaat

SEQ ID NO: 742640 - DNA, 13 bp, C. elegans
tttgcaaatatga

SEQ ID NO: 742641 - DNA, 13 bp, C. elegans
tttgcaaatggaa

SEQ ID NO: 742642 - DNA, 13 bp, C. elegans
tttgcaaatttcc

SEQ ID NO: 742643 - DNA, 13 bp, C. elegans
tttgcaacaaaaa

SEQ ID NO: 742644 - DNA, 13 bp, C. elegans
tttgcaacaaagt

SEQ ID NO: 742645 - DNA, 13 bp, C. elegans
tttgcaacaagaa

SEQ ID NO: 742646 - DNA, 13 bp, C. elegans
tttgcaacaatta

SEQ ID NO: 742647 - DNA, 13 bp, C. elegans
tttgcaacaattc

SEQ ID NO: 742648 - DNA, 13 bp, C. elegans
tttgcaactaatt

SEQ ID NO: 742649 - DNA, 13 bp, C. elegans
tttgcaagatgtc

SEQ ID NO: 742650 - DNA, 13 bp, C. elegans
tttgcaagatttt

SEQ ID NO: 742651 - DNA, 13 bp, C. elegans
tttgcaagcattt

SEQ ID NO: 742652 - DNA, 13 bp, C. elegans
tttgcaagtttca

SEQ ID NO: 742653 - DNA, 13 bp, C. elegans
tttgcaataaatt

SEQ ID NO: 742654 - DNA, 13 bp, C. elegans
tttgcaatattat

SEQ ID NO: 742655 - DNA, 13 bp, C. elegans
tttgcaatattct

SEQ ID NO: 742656 - DNA, 13 bp, C. elegans
tttgcaatattta

SEQ ID NO: 742657 - DNA, 13 bp, C. elegans
tttgcaatgaaat

SEQ ID NO: 742658 - DNA, 13 bp, C. elegans
tttgcaatgtttc

SEQ ID NO: 742659 - DNA, 13 bp, C. elegans
tttgcaattattc

SEQ ID NO: 742660 - DNA, 13 bp, C. elegans
tttgcaattattt

SEQ ID NO: 742661 - DNA, 13 bp, C. elegans
tttgcaatttata

SEQ ID NO: 742662 - DNA, 13 bp, C. elegans
tttgcaatttcag

SEQ ID NO: 742663 - DNA, 13 bp, C. elegans
tttgcaatttcat

SEQ ID NO: 742664 - DNA, 13 bp, C. elegans
tttgcaatttcta

SEQ ID NO: 742665 - DNA, 13 bp, C. elegans
tttgcaatttctg

SEQ ID NO: 742666 - DNA, 13 bp, C. elegans
tttgcaattttgg

SEQ ID NO: 742667 - DNA, 13 bp, C. elegans
tttgcaattttta

SEQ ID NO: 742668 - DNA, 13 bp, C. elegans
tttgcacaaaaac

SEQ ID NO: 742669 - DNA, 13 bp, C. elegans
tttgcacaaaaag

SEQ ID NO: 742670 - DNA, 13 bp, C. elegans
tttgcacaaaaat

SEQ ID NO: 742671 - DNA, 13 bp, C. elegans
tttgcacaaaatt

SEQ ID NO: 742672 - DNA, 13 bp, C. elegans
tttgcacaagaaa

SEQ ID NO: 742673 - DNA, 13 bp, C. elegans
tttgcacaattct

SEQ ID NO: 742674 - DNA, 13 bp, C. elegans
tttgcacattctt

SEQ ID NO: 742675 - DNA, 13 bp, C. elegans
tttgcacatttca

SEQ ID NO: 742676 - DNA, 13 bp, C. elegans
tttgcaccaaatt

SEQ ID NO: 742677 - DNA, 13 bp, C. elegans
tttgcaccagaaa

SEQ ID NO: 742678 - DNA, 13 bp, C. elegans
tttgcaccatttt

SEQ ID NO: 742679 - DNA, 13 bp, C. elegans
tttgcacgaaaaa

SEQ ID NO: 742680 - DNA, 13 bp, C. elegans
tttgcactaattt

SEQ ID NO: 742681 - DNA, 24 bp, C. elegans
tttgcacttatgaactcaaacttt

SEQ ID NO: 742682 - DNA, 13 bp, C. elegans
tttgcactttcaa

SEQ ID NO: 742683 - DNA, 13 bp, C. elegans
tttgcagaaaaaa

SEQ ID NO: 742684 - DNA, 13 bp, C. elegans
tttgcagaaaaga

SEQ ID NO: 742685 - DNA, 13 bp, C. elegans
tttgcagaaaatc

SEQ ID NO: 742686 - DNA, 13 bp, C. elegans
tttgcagaaagtt

SEQ ID NO: 742687 - DNA, 13 bp, C. elegans
tttgcagaaattt

SEQ ID NO: 742688 - DNA, 13 bp, C. elegans
tttgcagaattaa

SEQ ID NO: 742689 - DNA, 13 bp, C. elegans
tttgcagaatttg

SEQ ID NO: 742690 - DNA, 13 bp, C. elegans
tttgcagactttt

SEQ ID NO: 742691 - DNA, 13 bp, C. elegans
tttgcagagaaaa

SEQ ID NO: 742692 - DNA, 13 bp, C. elegans
tttgcagattttc

SEQ ID NO: 742693 - DNA, 13 bp, C. elegans
tttgcagcaaaat

SEQ ID NO: 742694 - DNA, 13 bp, C. elegans
tttgcagccgaca

SEQ ID NO: 742695 - DNA, 13 bp, C. elegans
tttgcaggaaaaa

SEQ ID NO: 742696 - DNA, 13 bp, C. elegans
tttgcagtaaaat

SEQ ID NO: 742697 - DNA, 13 bp, C. elegans
tttgcagtgaaaa

SEQ ID NO: 742698 - DNA, 13 bp, C. elegans
tttgcagtgacat

SEQ ID NO: 742699 - DNA, 13 bp, C. elegans
tttgcagttcaaa

SEQ ID NO: 742700 - DNA, 13 bp, C. elegans
tttgcagttgaaa

SEQ ID NO: 742701 - DNA, 13 bp, C. elegans
tttgcagttgaca

SEQ ID NO: 742702 - DNA, 13 bp, C. elegans
tttgcagttggaa

SEQ ID NO: 742703 - DNA, 13 bp, C. elegans
tttgcagtttgta

SEQ ID NO: 742704 - DNA, 13 bp, C. elegans
tttgcagttttaa

SEQ ID NO: 742705 - DNA, 13 bp, C. elegans
tttgcagttttcc

SEQ ID NO: 742706 - DNA, 13 bp, C. elegans
tttgcagttttgt

SEQ ID NO: 742707 - DNA, 13 bp, C. elegans
tttgcagtttttc

SEQ ID NO: 742708 - DNA, 13 bp, C. elegans
tttgcagtttttg

SEQ ID NO: 742709 - DNA, 13 bp, C. elegans
tttgcataaaatt

SEQ ID NO: 742710 - DNA, 13 bp, C. elegans
tttgcataataaa

SEQ ID NO: 742711 - DNA, 13 bp, C. elegans
tttgcataattat

SEQ ID NO: 742712 - DNA, 14 bp, C. elegans
tttgcataatttta

SEQ ID NO: 742713 - DNA, 13 bp, C. elegans
tttgcatatttct

SEQ ID NO: 742714 - DNA, 13 bp, C. elegans
tttgcatatttga

SEQ ID NO: 742715 - DNA, 13 bp, C. elegans
tttgcatcaaatt

SEQ ID NO: 742716 - DNA, 13 bp, C. elegans
tttgcatcgattt

SEQ ID NO: 742717 - DNA, 13 bp, C. elegans
tttgcatctaaaa

SEQ ID NO: 742718 - DNA, 13 bp, C. elegans
tttgcatgttttc

SEQ ID NO: 742719 - DNA, 13 bp, C. elegans
tttgcattatttc

SEQ ID NO: 742720 - DNA, 13 bp, C. elegans
tttgcattatttg

SEQ ID NO: 742721 - DNA, 13 bp, C. elegans
tttgcattcaatt

SEQ ID NO: 742722 - DNA, 13 bp, C. elegans
tttgcattcattt

SEQ ID NO: 742723 - DNA, 13 bp, C. elegans
tttgcattgaaat

SEQ ID NO: 742724 - DNA, 13 bp, C. elegans
tttgcattgtttc

SEQ ID NO: 742725 - DNA, 13 bp, C. elegans
tttgcatttatta

SEQ ID NO: 742726 - DNA, 13 bp, C. elegans
tttgcatttgtct

SEQ ID NO: 742727 - DNA, 13 bp, C. elegans
tttgcattttaca

SEQ ID NO: 742728 - DNA, 13 bp, C. elegans
tttgcattttatg

SEQ ID NO: 742729 - DNA, 13 bp, C. elegans
tttgcattttcaa

SEQ ID NO: 742730 - DNA, 13 bp, C. elegans
tttgcatttttac

SEQ ID NO: 742731 - DNA, 13 bp, C. elegans
tttgcatttttag

SEQ ID NO: 742732 - DNA, 13 bp, C. elegans
tttgccaaaaaat

SEQ ID NO: 742733 - DNA, 13 bp, C. elegans
tttgccaaaaacg

SEQ ID NO: 742734 - DNA, 13 bp, C. elegans
tttgccaaaactt

SEQ ID NO: 742735 - DNA, 13 bp, C. elegans
tttgccaaaagtt

SEQ ID NO: 742736 - DNA, 13 bp, C. elegans
tttgccaaacaaa

SEQ ID NO: 742737 - DNA, 13 bp, C. elegans
tttgccaaacggc

SEQ ID NO: 742738 - DNA, 13 bp, C. elegans
tttgccaaacttt

SEQ ID NO: 742739 - DNA, 13 bp, C. elegans
tttgccaaataaa

SEQ ID NO: 742740 - DNA, 13 bp, C. elegans
tttgccaaattta

SEQ ID NO: 742741 - DNA, 13 bp, C. elegans
tttgccaaatttg

SEQ ID NO: 742742 - DNA, 13 bp, C. elegans
tttgccaacaatt

SEQ ID NO: 742743 - DNA, 13 bp, C. elegans
tttgccaacattt

SEQ ID NO: 742744 - DNA, 13 bp, C. elegans
tttgccaacttgc

SEQ ID NO: 742745 - DNA, 13 bp, C. elegans
tttgccaagaatt

SEQ ID NO: 742746 - DNA, 13 bp, C. elegans
tttgccaataatt

SEQ ID NO: 742747 - DNA, 13 bp, C. elegans
tttgccaattatt

SEQ ID NO: 742748 - DNA, 13 bp, C. elegans
tttgccaattttc

SEQ ID NO: 742749 - DNA, 13 bp, C. elegans
tttgccaattttt

SEQ ID NO: 742750 - DNA, 13 bp, C. elegans
tttgccacaaatt

SEQ ID NO: 742751 - DNA, 13 bp, C. elegans
tttgccaccattt

SEQ ID NO: 742752 - DNA, 13 bp, C. elegans
tttgccacctttc

SEQ ID NO: 742753 - DNA, 13 bp, C. elegans
tttgccacgtgga

SEQ ID NO: 742754 - DNA, 13 bp, C. elegans
tttgccacgtggc

SEQ ID NO: 742755 - DNA, 13 bp, C. elegans
tttgccactttct

SEQ ID NO: 742756 - DNA, 13 bp, C. elegans
tttgccataaatt

SEQ ID NO: 742757 - DNA, 13 bp, C. elegans
tttgccatttaaa

SEQ ID NO: 742758 - DNA, 13 bp, C. elegans
tttgccattttcc

SEQ ID NO: 742759 - DNA, 13 bp, C. elegans
tttgccattttct

SEQ ID NO: 742760 - DNA, 13 bp, C. elegans
tttgccattttga

SEQ ID NO: 742761 - DNA, 13 bp, C. elegans
tttgccattttgc

SEQ ID NO: 742762 - DNA, 13 bp, C. elegans
tttgccattttta

SEQ ID NO: 742763 - DNA, 13 bp, C. elegans
tttgccatttttg

SEQ ID NO: 742764 - DNA, 13 bp, C. elegans
tttgcccaaaaaa

SEQ ID NO: 742765 - DNA, 13 bp, C. elegans
tttgcccaaaact

SEQ ID NO: 742766 - DNA, 14 bp, C. elegans
tttgcccattttca

SEQ ID NO: 742767 - DNA, 13 bp, C. elegans
tttgccgaaaaaa

SEQ ID NO: 742768 - DNA, 13 bp, C. elegans
tttgccgaaaaac

SEQ ID NO: 742769 - DNA, 13 bp, C. elegans
tttgccgaaaact

SEQ ID NO: 742770 - DNA, 13 bp, C. elegans
tttgccgaagatt

SEQ ID NO: 742771 - DNA, 13 bp, C. elegans
tttgccgaatatt

SEQ ID NO: 742772 - DNA, 13 bp, C. elegans
tttgccgaatggc

SEQ ID NO: 742773 - DNA, 13 bp, C. elegans
tttgccgaattgc

SEQ ID NO: 742774 - DNA, 13 bp, C. elegans
tttgccgagtttg

SEQ ID NO: 742775 - DNA, 13 bp, C. elegans
tttgccgattgaa

SEQ ID NO: 742776 - DNA, 13 bp, C. elegans
tttgccgatttat

SEQ ID NO: 742777 - DNA, 13 bp, C. elegans
tttgccgatttgt

SEQ ID NO: 742778 - DNA, 13 bp, C. elegans
tttgccgattttt

SEQ ID NO: 742779 - DNA, 13 bp, C. elegans
tttgccggaaaaa

SEQ ID NO: 742780 - DNA, 13 bp, C. elegans
tttgccggaaact

SEQ ID NO: 742781 - DNA, 13 bp, C. elegans
tttgccggaattt

SEQ ID NO: 742782 - DNA, 13 bp, C. elegans
tttgccggatttg

SEQ ID NO: 742783 - DNA, 13 bp, C. elegans
tttgccgggctcg

SEQ ID NO: 742784 - DNA, 13 bp, C. elegans
tttgccgtatttg

SEQ ID NO: 742785 - DNA, 13 bp, C. elegans
tttgcctaaaaat

SEQ ID NO: 742786 - DNA, 13 bp, C. elegans
tttgcctataaaa

SEQ ID NO: 742787 - DNA, 13 bp, C. elegans
tttgcctatttct

SEQ ID NO: 742788 - DNA, 13 bp, C. elegans
tttgcctcaaaaa

SEQ ID NO: 742789 - DNA, 13 bp, C. elegans
tttgcctcaaatt

SEQ ID NO: 742790 - DNA, 13 bp, C. elegans
tttgcctgaaaat

SEQ ID NO: 742791 - DNA, 13 bp, C. elegans
tttgcctgaaatt

SEQ ID NO: 742792 - DNA, 13 bp, C. elegans
tttgccttttata

SEQ ID NO: 742793 - DNA, 13 bp, C. elegans
tttgccttttgaa

SEQ ID NO: 742794 - DNA, 13 bp, C. elegans
tttgcctttttca

SEQ ID NO: 742795 - DNA, 13 bp, C. elegans
tttgcgaaaaaaa

SEQ ID NO: 742796 - DNA, 13 bp, C. elegans
tttgcgaaaaagt

SEQ ID NO: 742797 - DNA, 13 bp, C. elegans
tttgcgaaaactt

SEQ ID NO: 742798 - DNA, 13 bp, C. elegans
tttgcgaaattaa

SEQ ID NO: 742799 - DNA, 13 bp, C. elegans
tttgcgaatttta

SEQ ID NO: 742800 - DNA, 13 bp, C. elegans
tttgcgaattttg

SEQ ID NO: 742801 - DNA, 13 bp, C. elegans
tttgcgataaatt

SEQ ID NO: 742802 - DNA, 13 bp, C. elegans
tttgcgattaaaa

SEQ ID NO: 742803 - DNA, 13 bp, C. elegans
tttgcgattttaa

SEQ ID NO: 742804 - DNA, 13 bp, C. elegans
tttgcgatttttg

SEQ ID NO: 742805 - DNA, 13 bp, C. elegans
tttgcgcaatttt

SEQ ID NO: 742806 - DNA, 13 bp, C. elegans
tttgcgcctcact

SEQ ID NO: 742807 - DNA, 13 bp, C. elegans
tttgcgcggaaat

SEQ ID NO: 742808 - DNA, 13 bp, C. elegans
tttgcgcgggttt

SEQ ID NO: 742809 - DNA, 13 bp, C. elegans
tttgcgcgtcaaa

SEQ ID NO: 742810 - DNA, 13 bp, C. elegans
tttgcggaaattc

SEQ ID NO: 742811 - DNA, 13 bp, C. elegans
tttgcgggaaaaa

SEQ ID NO: 742812 - DNA, 13 bp, C. elegans
tttgcgtatttcc

SEQ ID NO: 742813 - DNA, 13 bp, C. elegans
tttgcgtatttct

SEQ ID NO: 742814 - DNA, 13 bp, C. elegans
tttgcgtcaaaaa

SEQ ID NO: 742815 - DNA, 13 bp, C. elegans
tttgcgttttcca

SEQ ID NO: 742816 - DNA, 13 bp, C. elegans
tttgcgtttttag

SEQ ID NO: 742817 - DNA, 13 bp, C. elegans
tttgctaaaactt

SEQ ID NO: 742818 - DNA, 13 bp, C. elegans
tttgctaaattta

SEQ ID NO: 742819 - DNA, 13 bp, C. elegans
tttgctaatttgc

SEQ ID NO: 742820 - DNA, 13 bp, C. elegans
tttgctaatttta

SEQ ID NO: 742821 - DNA, 13 bp, C. elegans
tttgctaattttc

SEQ ID NO: 742822 - DNA, 13 bp, C. elegans
tttgctacaaaaa

SEQ ID NO: 742823 - DNA, 13 bp, C. elegans
tttgctacaaaat

SEQ ID NO: 742824 - DNA, 13 bp, C. elegans
tttgctacatttt

SEQ ID NO: 742825 - DNA, 13 bp, C. elegans
tttgctacgtggc

SEQ ID NO: 742826 - DNA, 13 bp, C. elegans
tttgctacttttc

SEQ ID NO: 742827 - DNA, 13 bp, C. elegans
tttgctagaaatt

SEQ ID NO: 742828 - DNA, 13 bp, C. elegans
tttgctataaaat

SEQ ID NO: 742829 - DNA, 13 bp, C. elegans
tttgctattgaaa

SEQ ID NO: 742830 - DNA, 13 bp, C. elegans
tttgctatttgaa

SEQ ID NO: 742831 - DNA, 13 bp, C. elegans
tttgctcaaaaac

SEQ ID NO: 742832 - DNA, 13 bp, C. elegans
tttgctcaaaagt

SEQ ID NO: 742833 - DNA, 13 bp, C. elegans
tttgctcaaaatc

SEQ ID NO: 742834 - DNA, 13 bp, C. elegans
tttgctcaacttt

SEQ ID NO: 742835 - DNA, 13 bp, C. elegans
tttgctcactttt

SEQ ID NO: 742836 - DNA, 13 bp, C. elegans
tttgctcatattt

SEQ ID NO: 742837 - DNA, 13 bp, C. elegans
tttgctcatttca

SEQ ID NO: 742838 - DNA, 13 bp, C. elegans
tttgctcatttcc

SEQ ID NO: 742839 - DNA, 13 bp, C. elegans
tttgctcatttct

SEQ ID NO: 742840 - DNA, 13 bp, C. elegans
tttgctcattttc

SEQ ID NO: 742841 - DNA, 13 bp, C. elegans
tttgctccaaaaa

SEQ ID NO: 742842 - DNA, 13 bp, C. elegans
tttgctccaaaat

SEQ ID NO: 742843 - DNA, 13 bp, C. elegans
tttgctccaaact

SEQ ID NO: 742844 - DNA, 13 bp, C. elegans
tttgctccatatt

SEQ ID NO: 742845 - DNA, 13 bp, C. elegans
tttgctccatcag

SEQ ID NO: 742846 - DNA, 13 bp, C. elegans
tttgctcgaaaaa

SEQ ID NO: 742847 - DNA, 13 bp, C. elegans
tttgctcgaaatt

SEQ ID NO: 742848 - DNA, 13 bp, C. elegans
tttgctctcattt

SEQ ID NO: 742849 - DNA, 13 bp, C. elegans
tttgctcttttca

SEQ ID NO: 742850 - DNA, 13 bp, C. elegans
tttgctgaaaaaa

SEQ ID NO: 742851 - DNA, 13 bp, C. elegans
tttgctgaaaaat

SEQ ID NO: 742852 - DNA, 13 bp, C. elegans
tttgctgaaaact

SEQ ID NO: 742853 - DNA, 13 bp, C. elegans
tttgctgaaaagt

SEQ ID NO: 742854 - DNA, 13 bp, C. elegans
tttgctgaaactt

SEQ ID NO: 742855 - DNA, 13 bp, C. elegans
tttgctgaaatct

SEQ ID NO: 742856 - DNA, 13 bp, C. elegans
tttgctgaaattc

SEQ ID NO: 742857 - DNA, 13 bp, C. elegans
tttgctgctcaaa

SEQ ID NO: 742858 - DNA, 13 bp, C. elegans
tttgctggaaaaa

SEQ ID NO: 742859 - DNA, 13 bp, C. elegans
tttgctggaaatc

SEQ ID NO: 742860 - DNA, 13 bp, C. elegans
tttgctggaaatt

SEQ ID NO: 742861 - DNA, 13 bp, C. elegans
tttgctggaagtt

SEQ ID NO: 742862 - DNA, 13 bp, C. elegans
tttgctggaattg

SEQ ID NO: 742863 - DNA, 13 bp, C. elegans
tttgctggaattt

SEQ ID NO: 742864 - DNA, 13 bp, C. elegans
tttgctggtattt

SEQ ID NO: 742865 - DNA, 13 bp, C. elegans
tttgctgtaaaaa

SEQ ID NO: 742866 - DNA, 13 bp, C. elegans
tttgcttactatt

SEQ ID NO: 742867 - DNA, 13 bp, C. elegans
tttgcttcaaaaa

SEQ ID NO: 742868 - DNA, 13 bp, C. elegans
tttgcttcaaaac

SEQ ID NO: 742869 - DNA, 13 bp, C. elegans
tttgcttcaaaat

SEQ ID NO: 742870 - DNA, 13 bp, C. elegans
tttgcttcaaatt

SEQ ID NO: 742871 - DNA, 13 bp, C. elegans
tttgcttccaaaa

SEQ ID NO: 742872 - DNA, 13 bp, C. elegans
tttgcttcgaaaa

SEQ ID NO: 742873 - DNA, 13 bp, C. elegans
tttgcttttccaa

SEQ ID NO: 742874 - DNA, 13 bp, C. elegans
tttgctttttaaa

SEQ ID NO: 742875 - DNA, 13 bp, C. elegans
tttgctttttcca

SEQ ID NO: 742876 - DNA, 13 bp, C. elegans
tttggaaaaaact

SEQ ID NO: 742877 - DNA, 13 bp, C. elegans
tttggaaaaaatc

SEQ ID NO: 742878 - DNA, 13 bp, C. elegans
tttggaaaaaccg

SEQ ID NO: 742879 - DNA, 13 bp, C. elegans
tttggaaaaagaa

SEQ ID NO: 742880 - DNA, 13 bp, C. elegans
tttggaaaaagct

SEQ ID NO: 742881 - DNA, 13 bp, C. elegans
tttggaaaaatca

SEQ ID NO: 742882 - DNA, 13 bp, C. elegans
tttggaaaaatga

SEQ ID NO: 742883 - DNA, 13 bp, C. elegans
tttggaaaaatta

SEQ ID NO: 742884 - DNA, 13 bp, C. elegans
tttggaaaacaac

SEQ ID NO: 742885 - DNA, 13 bp, C. elegans
tttggaaaacaat

SEQ ID NO: 742886 - DNA, 13 bp, C. elegans
tttggaaaacatt

SEQ ID NO: 742887 - DNA, 13 bp, C. elegans
tttggaaaacgtg

SEQ ID NO: 742888 - DNA, 13 bp, C. elegans
tttggaaaactag

SEQ ID NO: 742889 - DNA, 13 bp, C. elegans
tttggaaaactct

SEQ ID NO: 742890 - DNA, 13 bp, C. elegans
tttggaaaactga

SEQ ID NO: 742891 - DNA, 13 bp, C. elegans
tttggaaaacttc

SEQ ID NO: 742892 - DNA, 13 bp, C. elegans
tttggaaaagaat

SEQ ID NO: 742893 - DNA, 13 bp, C. elegans
tttggaaaagaga

SEQ ID NO: 742894 - DNA, 13 bp, C. elegans
tttggaaaagctt

SEQ ID NO: 742895 - DNA, 13 bp, C. elegans
tttggaaaagtga

SEQ ID NO: 742896 - DNA, 13 bp, C. elegans
tttggaaaagtgt

SEQ ID NO: 742897 - DNA, 13 bp, C. elegans
tttggaaaataaa

SEQ ID NO: 742898 - DNA, 13 bp, C. elegans
tttggaaaatagc

SEQ ID NO: 742899 - DNA, 13 bp, C. elegans
tttggaaaatatc

SEQ ID NO: 742900 - DNA, 13 bp, C. elegans
tttggaaaatgag

SEQ ID NO: 742901 - DNA, 13 bp, C. elegans
tttggaaaatgtg

SEQ ID NO: 742902 - DNA, 13 bp, C. elegans
tttggaaaatgtt

SEQ ID NO: 742903 - DNA, 13 bp, C. elegans
tttggaaaattag

SEQ ID NO: 742904 - DNA, 13 bp, C. elegans
tttggaaaattat

SEQ ID NO: 742905 - DNA, 13 bp, C. elegans
tttggaaaattga

SEQ ID NO: 742906 - DNA, 13 bp, C. elegans
tttggaaaatttc

SEQ ID NO: 742907 - DNA, 13 bp, C. elegans
tttggaaaatttt

SEQ ID NO: 742908 - DNA, 13 bp, C. elegans
tttggaaacaaat

SEQ ID NO: 742909 - DNA, 13 bp, C. elegans
tttggaaacttca

SEQ ID NO: 742910 - DNA, 13 bp, C. elegans
tttggaaacttgt

SEQ ID NO: 742911 - DNA, 13 bp, C. elegans
tttggaaagaaac

SEQ ID NO: 742912 - DNA, 13 bp, C. elegans
tttggaaagtctt

SEQ ID NO: 742913 - DNA, 13 bp, C. elegans
tttggaaagtttt

SEQ ID NO: 742914 - DNA, 13 bp, C. elegans
tttggaaatactt

SEQ ID NO: 742915 - DNA, 13 bp, C. elegans
tttggaaatatgt

SEQ ID NO: 742916 - DNA, 13 bp, C. elegans
tttggaaatcaaa

SEQ ID NO: 742917 - DNA, 13 bp, C. elegans
tttggaaatgtta

SEQ ID NO: 742918 - DNA, 13 bp, C. elegans
tttggaaatgttt

SEQ ID NO: 742919 - DNA, 13 bp, C. elegans
tttggaaattcat

SEQ ID NO: 742920 - DNA, 13 bp, C. elegans
tttggaaattgaa

SEQ ID NO: 742921 - DNA, 13 bp, C. elegans
tttggaaattgat

SEQ ID NO: 742922 - DNA, 13 bp, C. elegans
tttggaaattgta

SEQ ID NO: 742923 - DNA, 13 bp, C. elegans
tttggaaattgtg

SEQ ID NO: 742924 - DNA, 13 bp, C. elegans
tttggaaattgtt

SEQ ID NO: 742925 - DNA, 13 bp, C. elegans
tttggaaatttat

SEQ ID NO: 742926 - DNA, 13 bp, C. elegans
tttggaaatttca

SEQ ID NO: 742927 - DNA, 13 bp, C. elegans
tttggaaatttgg

SEQ ID NO: 742928 - DNA, 13 bp, C. elegans
tttggaaatttgt

SEQ ID NO: 742929 - DNA, 13 bp, C. elegans
tttggaaatttta

SEQ ID NO: 742930 - DNA, 13 bp, C. elegans
tttggaacaaaaa

SEQ ID NO: 742931 - DNA, 13 bp, C. elegans
tttggaacaaaat

SEQ ID NO: 742932 - DNA, 13 bp, C. elegans
tttggaacaactt

SEQ ID NO: 742933 - DNA, 13 bp, C. elegans
tttggaacagtat

SEQ ID NO: 742934 - DNA, 13 bp, C. elegans
tttggaacatgaa

SEQ ID NO: 742935 - DNA, 13 bp, C. elegans
tttggaacgaaaa

SEQ ID NO: 742936 - DNA, 13 bp, C. elegans
tttggaacgattt

SEQ ID NO: 742937 - DNA, 13 bp, C. elegans
tttggaactacag

SEQ ID NO: 742938 - DNA, 13 bp, C. elegans
tttggaactttga

SEQ ID NO: 742939 - DNA, 13 bp, C. elegans
tttggaacttttc

SEQ ID NO: 742940 - DNA, 13 bp, C. elegans
tttggaagaaaac

SEQ ID NO: 742941 - DNA, 13 bp, C. elegans
tttggaagaaagt

SEQ ID NO: 742942 - DNA, 13 bp, C. elegans
tttggaagaagtt

SEQ ID NO: 742943 - DNA, 13 bp, C. elegans
tttggaagagttt

SEQ ID NO: 742944 - DNA, 13 bp, C. elegans
tttggaagatttt

SEQ ID NO: 742945 - DNA, 13 bp, C. elegans
tttggaagcaaaa

SEQ ID NO: 742946 - DNA, 13 bp, C. elegans
tttggaagtcgac

SEQ ID NO: 742947 - DNA, 13 bp, C. elegans
tttggaagttatt

SEQ ID NO: 742948 - DNA, 13 bp, C. elegans
tttggaagtttaa

SEQ ID NO: 742949 - DNA, 13 bp, C. elegans
tttggaataaaaa

SEQ ID NO: 742950 - DNA, 13 bp, C. elegans
tttggaataaaat

SEQ ID NO: 742951 - DNA, 13 bp, C. elegans
tttggaataaata

SEQ ID NO: 742952 - DNA, 13 bp, C. elegans
tttggaataaatt

SEQ ID NO: 742953 - DNA, 13 bp, C. elegans
tttggaataattt

SEQ ID NO: 742954 - DNA, 13 bp, C. elegans
tttggaatatatt

SEQ ID NO: 742955 - DNA, 13 bp, C. elegans
tttggaatatgtg

SEQ ID NO: 742956 - DNA, 13 bp, C. elegans
tttggaatcattt

SEQ ID NO: 742957 - DNA, 13 bp, C. elegans
tttggaatctttt

SEQ ID NO: 742958 - DNA, 13 bp, C. elegans
tttggaatgaata

SEQ ID NO: 742959 - DNA, 13 bp, C. elegans
tttggaatgaatt

SEQ ID NO: 742960 - DNA, 13 bp, C. elegans
tttggaatggaaa

SEQ ID NO: 742961 - DNA, 13 bp, C. elegans
tttggaattatcg

SEQ ID NO: 742962 - DNA, 13 bp, C. elegans
tttggaattatta

SEQ ID NO: 742963 - DNA, 13 bp, C. elegans
tttggaatttact

SEQ ID NO: 742964 - DNA, 14 bp, C. elegans
tttggaatttcaaa

SEQ ID NO: 742965 - DNA, 13 bp, C. elegans
tttggaattttag

SEQ ID NO: 742966 - DNA, 13 bp, C. elegans
tttggaattttcc

SEQ ID NO: 742967 - DNA, 13 bp, C. elegans
tttggaattttct

SEQ ID NO: 742968 - DNA, 13 bp, C. elegans
tttggaattttgc

SEQ ID NO: 742969 - DNA, 13 bp, C. elegans
tttggaatttttc

SEQ ID NO: 742970 - DNA, 13 bp, C. elegans
tttggacaaactt

SEQ ID NO: 742971 - DNA, 13 bp, C. elegans
tttggacaatttt

SEQ ID NO: 742972 - DNA, 13 bp, C. elegans
tttggacagtttt

SEQ ID NO: 742973 - DNA, 13 bp, C. elegans
tttggaccaattt

SEQ ID NO: 742974 - DNA, 13 bp, C. elegans
tttggaccatttt

SEQ ID NO: 742975 - DNA, 13 bp, C. elegans
tttggacgaaatt

SEQ ID NO: 742976 - DNA, 13 bp, C. elegans
tttggactaaaat

SEQ ID NO: 742977 - DNA, 13 bp, C. elegans
tttggactatttt

SEQ ID NO: 742978 - DNA, 13 bp, C. elegans
tttggagaaaaaa

SEQ ID NO: 742979 - DNA, 13 bp, C. elegans
tttggagaaaata

SEQ ID NO: 742980 - DNA, 13 bp, C. elegans
tttggagaaaatt

SEQ ID NO: 742981 - DNA, 13 bp, C. elegans
tttggagaacatt

SEQ ID NO: 742982 - DNA, 13 bp, C. elegans
tttggagaacttt

SEQ ID NO: 742983 - DNA, 13 bp, C. elegans
tttggagaagaag

SEQ ID NO: 742984 - DNA, 13 bp, C. elegans
tttggagaagttt

SEQ ID NO: 742985 - DNA, 13 bp, C. elegans
tttggagagaaaa

SEQ ID NO: 742986 - DNA, 13 bp, C. elegans
tttggagataaat

SEQ ID NO: 742987 - DNA, 13 bp, C. elegans
tttggagatcaaa

SEQ ID NO: 742988 - DNA, 13 bp, C. elegans
tttggagcaaaaa

SEQ ID NO: 742989 - DNA, 13 bp, C. elegans
tttggagcaactt

SEQ ID NO: 742990 - DNA, 13 bp, C. elegans
tttggagcaattc

SEQ ID NO: 742991 - DNA, 13 bp, C. elegans
tttggagcacatt

SEQ ID NO: 742992 - DNA, 13 bp, C. elegans
tttggagcacttt

SEQ ID NO: 742993 - DNA, 13 bp, C. elegans
tttggagcatttt

SEQ ID NO: 742994 - DNA, 13 bp, C. elegans
tttggagctcaaa

SEQ ID NO: 742995 - DNA, 13 bp, C. elegans
tttggagcttctt

SEQ ID NO: 742996 - DNA, 13 bp, C. elegans
tttggagcttttc

SEQ ID NO: 742997 - DNA, 13 bp, C. elegans
tttggagcttttt

SEQ ID NO: 742998 - DNA, 13 bp, C. elegans
tttggaggaaaaa

SEQ ID NO: 742999 - DNA, 13 bp, C. elegans
tttggaggaaaag

SEQ ID NO: 743000 - DNA, 13 bp, C. elegans
tttggaggaaaat

SEQ ID NO: 743001 - DNA, 13 bp, C. elegans
tttggaggaggaa

SEQ ID NO: 743002 - DNA, 13 bp, C. elegans
tttggaggatttt

SEQ ID NO: 743003 - DNA, 13 bp, C. elegans
tttggagggaaaa

SEQ ID NO: 743004 - DNA, 13 bp, C. elegans
tttggagtcaaaa

SEQ ID NO: 743005 - DNA, 13 bp, C. elegans
tttggagtcaatg

SEQ ID NO: 743006 - DNA, 13 bp, C. elegans
tttggagtgaaaa

SEQ ID NO: 743007 - DNA, 13 bp, C. elegans
tttggagtgattt

SEQ ID NO: 743008 - DNA, 13 bp, C. elegans
tttggagtttttc

SEQ ID NO: 743009 - DNA, 13 bp, C. elegans
tttggataaatat

SEQ ID NO: 743010 - DNA, 13 bp, C. elegans
tttggataaattt

SEQ ID NO: 743011 - DNA, 13 bp, C. elegans
tttggataacaaa

SEQ ID NO: 743012 - DNA, 13 bp, C. elegans
tttggatagaaaa

SEQ ID NO: 743013 - DNA, 13 bp, C. elegans
tttggatattaaa

SEQ ID NO: 743014 - DNA, 13 bp, C. elegans
tttggatatttca

SEQ ID NO: 743015 - DNA, 13 bp, C. elegans
tttggatatttct

SEQ ID NO: 743016 - DNA, 13 bp, C. elegans
tttggatcaaatt

SEQ ID NO: 743017 - DNA, 13 bp, C. elegans
tttggatcatttt

SEQ ID NO: 743018 - DNA, 16 bp, C. elegans
tttggatctcgagaaa

SEQ ID NO: 743019 - DNA, 13 bp, C. elegans
tttggatgaaaaa

SEQ ID NO: 743020 - DNA, 13 bp, C. elegans
tttggatgaactt

SEQ ID NO: 743021 - DNA, 13 bp, C. elegans
tttggattcaaat

SEQ ID NO: 743022 - DNA, 13 bp, C. elegans
tttggattctcct

SEQ ID NO: 743023 - DNA, 13 bp, C. elegans
tttggattgatct

SEQ ID NO: 743024 - DNA, 13 bp, C. elegans
tttggatttcttc

SEQ ID NO: 743025 - DNA, 13 bp, C. elegans
tttggatttggaa

SEQ ID NO: 743026 - DNA, 13 bp, C. elegans
tttggattttatc

SEQ ID NO: 743027 - DNA, 13 bp, C. elegans
tttggattttcct

SEQ ID NO: 743028 - DNA, 13 bp, C. elegans
tttggatttttac

SEQ ID NO: 743029 - DNA, 13 bp, C. elegans
tttggatttttcc

SEQ ID NO: 743030 - DNA, 13 bp, C. elegans
tttggcaaaaaaa

SEQ ID NO: 743031 - DNA, 13 bp, C. elegans
tttggcaaaaatc

SEQ ID NO: 743032 - DNA, 13 bp, C. elegans
tttggcaaaactt

SEQ ID NO: 743033 - DNA, 13 bp, C. elegans
tttggcaaaagtt

SEQ ID NO: 743034 - DNA, 13 bp, C. elegans
tttggcaaaatca

SEQ ID NO: 743035 - DNA, 13 bp, C. elegans
tttggcaaaatgt

SEQ ID NO: 743036 - DNA, 13 bp, C. elegans
tttggcaaatcgg

SEQ ID NO: 743037 - DNA, 13 bp, C. elegans
tttggcaacaaaa

SEQ ID NO: 743038 - DNA, 13 bp, C. elegans
tttggcaacaatt

SEQ ID NO: 743039 - DNA, 13 bp, C. elegans
tttggcaacttat

SEQ ID NO: 743040 - DNA, 13 bp, C. elegans
tttggcaactttt

SEQ ID NO: 743041 - DNA, 13 bp, C. elegans
tttggcaagtttt

SEQ ID NO: 743042 - DNA, 13 bp, C. elegans
tttggcaattttc

SEQ ID NO: 743043 - DNA, 13 bp, C. elegans
tttggcacaattt

SEQ ID NO: 743044 - DNA, 13 bp, C. elegans
tttggcaccatat

SEQ ID NO: 743045 - DNA, 13 bp, C. elegans
tttggcacttttt

SEQ ID NO: 743046 - DNA, 13 bp, C. elegans
tttggcagaaatt

SEQ ID NO: 743047 - DNA, 13 bp, C. elegans
tttggcagattgc

SEQ ID NO: 743048 - DNA, 13 bp, C. elegans
tttggcagatttt

SEQ ID NO: 743049 - DNA, 13 bp, C. elegans
tttggcaggaaaa

SEQ ID NO: 743050 - DNA, 13 bp, C. elegans
tttggcagtttac

SEQ ID NO: 743051 - DNA, 13 bp, C. elegans
tttggcagttttt

SEQ ID NO: 743052 - DNA, 13 bp, C. elegans
tttggcattgaaa

SEQ ID NO: 743053 - DNA, 13 bp, C. elegans
tttggcatttgaa

SEQ ID NO: 743054 - DNA, 13 bp, C. elegans
tttggcattttat

SEQ ID NO: 743055 - DNA, 13 bp, C. elegans
tttggcattttta

SEQ ID NO: 743056 - DNA, 13 bp, C. elegans
tttggcatttttg

SEQ ID NO: 743057 - DNA, 13 bp, C. elegans
tttggccaaaatt

SEQ ID NO: 743058 - DNA, 13 bp, C. elegans
tttggccaatttt

SEQ ID NO: 743059 - DNA, 13 bp, C. elegans
tttggccagcact

SEQ ID NO: 743060 - DNA, 13 bp, C. elegans
tttggccagtttt

SEQ ID NO: 743061 - DNA, 13 bp, C. elegans
tttggcccaaaaa

SEQ ID NO: 743062 - DNA, 13 bp, C. elegans
tttggcgccaaaa

SEQ ID NO: 743063 - DNA, 13 bp, C. elegans
tttggcgcgaaaa

SEQ ID NO: 743064 - DNA, 13 bp, C. elegans
tttggcgcgggaa

SEQ ID NO: 743065 - DNA, 13 bp, C. elegans
tttggcggaaaac

SEQ ID NO: 743066 - DNA, 13 bp, C. elegans
tttggcggaaaat

SEQ ID NO: 743067 - DNA, 13 bp, C. elegans
tttggcggcaaaa

SEQ ID NO: 743068 - DNA, 13 bp, C. elegans
tttggcgggaatt

SEQ ID NO: 743069 - DNA, 13 bp, C. elegans
tttggcgtcaaaa

SEQ ID NO: 743070 - DNA, 13 bp, C. elegans
tttggctaaaaac

SEQ ID NO: 743071 - DNA, 13 bp, C. elegans
tttggctaaactt

SEQ ID NO: 743072 - DNA, 13 bp, C. elegans
tttggctacaaaa

SEQ ID NO: 743073 - DNA, 13 bp, C. elegans
tttggctagtttt

SEQ ID NO: 743074 - DNA, 13 bp, C. elegans
tttggctcaaaaa

SEQ ID NO: 743075 - DNA, 13 bp, C. elegans
tttggctcaaatt

SEQ ID NO: 743076 - DNA, 13 bp, C. elegans
tttggctccaaat

SEQ ID NO: 743077 - DNA, 13 bp, C. elegans
tttggctgaaaat

SEQ ID NO: 743078 - DNA, 13 bp, C. elegans
tttggctgaaatt

SEQ ID NO: 743079 - DNA, 13 bp, C. elegans
tttggctgaattt

SEQ ID NO: 743080 - DNA, 13 bp, C. elegans
tttggctggaaat

SEQ ID NO: 743081 - DNA, 14 bp, C. elegans
tttggcttgggctt

SEQ ID NO: 743082 - DNA, 13 bp, C. elegans
tttgggaaaagct

SEQ ID NO: 743083 - DNA, 13 bp, C. elegans
tttgggaaaagtt

SEQ ID NO: 743084 - DNA, 13 bp, C. elegans
tttgggaaaataa

SEQ ID NO: 743085 - DNA, 13 bp, C. elegans
tttgggaaattaa

SEQ ID NO: 743086 - DNA, 13 bp, C. elegans
tttgggaataatt

SEQ ID NO: 743087 - DNA, 13 bp, C. elegans
tttgggaattcat

SEQ ID NO: 743088 - DNA, 13 bp, C. elegans
tttgggaatttat

SEQ ID NO: 743089 - DNA, 13 bp, C. elegans
tttgggaattttc

SEQ ID NO: 743090 - DNA, 13 bp, C. elegans
tttgggacaaaat

SEQ ID NO: 743091 - DNA, 13 bp, C. elegans
tttgggagaattt

SEQ ID NO: 743092 - DNA, 13 bp, C. elegans
tttgggatttgaa

SEQ ID NO: 743093 - DNA, 13 bp, C. elegans
tttgggattttaa

SEQ ID NO: 743094 - DNA, 13 bp, C. elegans
tttgggcaaaaat

SEQ ID NO: 743095 - DNA, 13 bp, C. elegans
tttgggcactttt

SEQ ID NO: 743096 - DNA, 13 bp, C. elegans
tttgggcatttta

SEQ ID NO: 743097 - DNA, 13 bp, C. elegans
tttgggcattttt

SEQ ID NO: 743098 - DNA, 13 bp, C. elegans
tttgggccaaatt

SEQ ID NO: 743099 - DNA, 13 bp, C. elegans
tttgggcgaaaaa

SEQ ID NO: 743100 - DNA, 13 bp, C. elegans
tttgggctcaaaa

SEQ ID NO: 743101 - DNA, 13 bp, C. elegans
tttggggaaaaaa

SEQ ID NO: 743102 - DNA, 13 bp, C. elegans
tttggggaaaatg

SEQ ID NO: 743103 - DNA, 13 bp, C. elegans
tttggggaaaatt

SEQ ID NO: 743104 - DNA, 13 bp, C. elegans
tttgggggaaatt

SEQ ID NO: 743105 - DNA, 13 bp, C. elegans
tttggggggaaaa

SEQ ID NO: 743106 - DNA, 13 bp, C. elegans
tttgggtcaaaat

SEQ ID NO: 743107 - DNA, 13 bp, C. elegans
tttgggtctaaaa

SEQ ID NO: 743108 - DNA, 13 bp, C. elegans
tttgggttttcaa

SEQ ID NO: 743109 - DNA, 13 bp, C. elegans
tttggtaaaaaac

SEQ ID NO: 743110 - DNA, 13 bp, C. elegans
tttggtaaaacgt

SEQ ID NO: 743111 - DNA, 13 bp, C. elegans
tttggtaaaacta

SEQ ID NO: 743112 - DNA, 13 bp, C. elegans
tttggtaactttt

SEQ ID NO: 743113 - DNA, 13 bp, C. elegans
tttggtaataaat

SEQ ID NO: 743114 - DNA, 13 bp, C. elegans
tttggtaatgaaa

SEQ ID NO: 743115 - DNA, 13 bp, C. elegans
tttggtaatttct

SEQ ID NO: 743116 - DNA, 13 bp, C. elegans
tttggtaattttc

SEQ ID NO: 743117 - DNA, 13 bp, C. elegans
tttggtacttgtg

SEQ ID NO: 743118 - DNA, 13 bp, C. elegans
tttggtagatcaa

SEQ ID NO: 743119 - DNA, 13 bp, C. elegans
tttggtagatctt

SEQ ID NO: 743120 - DNA, 14 bp, C. elegans
tttggtagctcata

SEQ ID NO: 743121 - DNA, 13 bp, C. elegans
tttggtataaaac

SEQ ID NO: 743122 - DNA, 13 bp, C. elegans
tttggtatttgct

SEQ ID NO: 743123 - DNA, 13 bp, C. elegans
tttggtcaaaaaa

SEQ ID NO: 743124 - DNA, 13 bp, C. elegans
tttggtcaacttc

SEQ ID NO: 743125 - DNA, 13 bp, C. elegans
tttggtcactttt

SEQ ID NO: 743126 - DNA, 13 bp, C. elegans
tttggtcattttc

SEQ ID NO: 743127 - DNA, 13 bp, C. elegans
tttggtcattttg

SEQ ID NO: 743128 - DNA, 13 bp, C. elegans
tttggtcctaaaa

SEQ ID NO: 743129 - DNA, 13 bp, C. elegans
tttggtcgaaaaa

SEQ ID NO: 743130 - DNA, 13 bp, C. elegans
tttggtcgatttc

SEQ ID NO: 743131 - DNA, 13 bp, C. elegans
tttggtctcgcca

SEQ ID NO: 743132 - DNA, 13 bp, C. elegans
tttggtcttcaat

SEQ ID NO: 743133 - DNA, 13 bp, C. elegans
tttggtgaaaact

SEQ ID NO: 743134 - DNA, 13 bp, C. elegans
tttggtgatgaat

SEQ ID NO: 743135 - DNA, 13 bp, C. elegans
tttggtgatttgc

SEQ ID NO: 743136 - DNA, 13 bp, C. elegans
tttggtgcaaaaa

SEQ ID NO: 743137 - DNA, 13 bp, C. elegans
tttggtgcaaaat

SEQ ID NO: 743138 - DNA, 13 bp, C. elegans
tttggtgcatttt

SEQ ID NO: 743139 - DNA, 13 bp, C. elegans
tttggtgctattt

SEQ ID NO: 743140 - DNA, 13 bp, C. elegans
tttggtgctgaaa

SEQ ID NO: 743141 - DNA, 13 bp, C. elegans
tttggtggaaatt

SEQ ID NO: 743142 - DNA, 13 bp, C. elegans
tttggtgtcaaaa

SEQ ID NO: 743143 - DNA, 13 bp, C. elegans
tttggtgtttaaa

SEQ ID NO: 743144 - DNA, 13 bp, C. elegans
tttggttactgta

SEQ ID NO: 743145 - DNA, 13 bp, C. elegans
tttggttataaaa

SEQ ID NO: 743146 - DNA, 13 bp, C. elegans
tttggttcaaatt

SEQ ID NO: 743147 - DNA, 13 bp, C. elegans
tttggttcaattt

SEQ ID NO: 743148 - DNA, 13 bp, C. elegans
tttggttgcaaaa

SEQ ID NO: 743149 - DNA, 13 bp, C. elegans
tttggtttcagaa

SEQ ID NO: 743150 - DNA, 13 bp, C. elegans
tttggtttcagat

SEQ ID NO: 743151 - DNA, 13 bp, C. elegans
tttggtttcagtt

SEQ ID NO: 743152 - DNA, 13 bp, C. elegans
tttggtttgaaaa

SEQ ID NO: 743153 - DNA, 13 bp, C. elegans
tttggtttggaaa

SEQ ID NO: 743154 - DNA, 13 bp, C. elegans
tttggttttcaaa

SEQ ID NO: 743155 - DNA, 13 bp, C. elegans
tttggttttgaaa

SEQ ID NO: 743156 - DNA, 13 bp, C. elegans
tttggttttgcat

SEQ ID NO: 743157 - DNA, 13 bp, C. elegans
tttggtttttcga

SEQ ID NO: 743158 - DNA, 13 bp, C. elegans
tttgtaaaaacaa

SEQ ID NO: 743159 - DNA, 13 bp, C. elegans
tttgtaaaaatga

SEQ ID NO: 743160 - DNA, 13 bp, C. elegans
tttgtaaaaatgt

SEQ ID NO: 743161 - DNA, 13 bp, C. elegans
tttgtaaaaccaa

SEQ ID NO: 743162 - DNA, 13 bp, C. elegans
tttgtaaaactga

SEQ ID NO: 743163 - DNA, 13 bp, C. elegans
tttgtaaaagttt

SEQ ID NO: 743164 - DNA, 13 bp, C. elegans
tttgtaaaatgtt

SEQ ID NO: 743165 - DNA, 13 bp, C. elegans
tttgtaaaatttc

SEQ ID NO: 743166 - DNA, 13 bp, C. elegans
tttgtaaaatttg

SEQ ID NO: 743167 - DNA, 13 bp, C. elegans
tttgtaaacattt

SEQ ID NO: 743168 - DNA, 13 bp, C. elegans
tttgtaaacgttt

SEQ ID NO: 743169 - DNA, 13 bp, C. elegans
tttgtaaactttg

SEQ ID NO: 743170 - DNA, 13 bp, C. elegans
tttgtaaagttct

SEQ ID NO: 743171 - DNA, 13 bp, C. elegans
tttgtaaatatgt

SEQ ID NO: 743172 - DNA, 13 bp, C. elegans
tttgtaaatttac

SEQ ID NO: 743173 - DNA, 13 bp, C. elegans
tttgtaaatttca

SEQ ID NO: 743174 - DNA, 13 bp, C. elegans
tttgtaaatttct

SEQ ID NO: 743175 - DNA, 13 bp, C. elegans
tttgtaacaaaat

SEQ ID NO: 743176 - DNA, 13 bp, C. elegans
tttgtaacattaa

SEQ ID NO: 743177 - DNA, 13 bp, C. elegans
tttgtaacatttc

SEQ ID NO: 743178 - DNA, 13 bp, C. elegans
tttgtaacatttt

SEQ ID NO: 743179 - DNA, 13 bp, C. elegans
tttgtaactttat

SEQ ID NO: 743180 - DNA, 13 bp, C. elegans
tttgtaactttga

SEQ ID NO: 743181 - DNA, 13 bp, C. elegans
tttgtaagaaaaa

SEQ ID NO: 743182 - DNA, 13 bp, C. elegans
tttgtaagtttga

SEQ ID NO: 743183 - DNA, 13 bp, C. elegans
tttgtaagttttc

SEQ ID NO: 743184 - DNA, 13 bp, C. elegans
tttgtaatattct

SEQ ID NO: 743185 - DNA, 13 bp, C. elegans
tttgtaatgaaaa

SEQ ID NO: 743186 - DNA, 13 bp, C. elegans
tttgtaatgcaaa

SEQ ID NO: 743187 - DNA, 13 bp, C. elegans
tttgtaatggaaa

SEQ ID NO: 743188 - DNA, 13 bp, C. elegans
tttgtaattcaaa

SEQ ID NO: 743189 - DNA, 13 bp, C. elegans
tttgtaatttaca

SEQ ID NO: 743190 - DNA, 13 bp, C. elegans
tttgtaatttcag

SEQ ID NO: 743191 - DNA, 13 bp, C. elegans
tttgtaattttca

SEQ ID NO: 743192 - DNA, 13 bp, C. elegans
tttgtaattttcc

SEQ ID NO: 743193 - DNA, 13 bp, C. elegans
tttgtacaaaaag

SEQ ID NO: 743194 - DNA, 13 bp, C. elegans
tttgtacaagttt

SEQ ID NO: 743195 - DNA, 13 bp, C. elegans
tttgtacaattat

SEQ ID NO: 743196 - DNA, 13 bp, C. elegans
tttgtacaattta

SEQ ID NO: 743197 - DNA, 13 bp, C. elegans
tttgtacaatttc

SEQ ID NO: 743198 - DNA, 13 bp, C. elegans
tttgtacagaaat

SEQ ID NO: 743199 - DNA, 13 bp, C. elegans
tttgtacataaat

SEQ ID NO: 743200 - DNA, 14 bp, C. elegans
tttgtacatatcat

SEQ ID NO: 743201 - DNA, 13 bp, C. elegans
tttgtacatttct

SEQ ID NO: 743202 - DNA, 13 bp, C. elegans
tttgtaccaattt

SEQ ID NO: 743203 - DNA, 13 bp, C. elegans
tttgtacttgaaa

SEQ ID NO: 743204 - DNA, 13 bp, C. elegans
tttgtagaaaaaa

SEQ ID NO: 743205 - DNA, 13 bp, C. elegans
tttgtagaaattc

SEQ ID NO: 743206 - DNA, 13 bp, C. elegans
tttgtagaacatt

SEQ ID NO: 743207 - DNA, 13 bp, C. elegans
tttgtagaatatt

SEQ ID NO: 743208 - DNA, 13 bp, C. elegans
tttgtagatcaat

SEQ ID NO: 743209 - DNA, 13 bp, C. elegans
tttgtagatttac

SEQ ID NO: 743210 - DNA, 13 bp, C. elegans
tttgtagatttct

SEQ ID NO: 743211 - DNA, 13 bp, C. elegans
tttgtagcctagc

SEQ ID NO: 743212 - DNA, 13 bp, C. elegans
tttgtagcttgta

SEQ ID NO: 743213 - DNA, 13 bp, C. elegans
tttgtagcttttc

SEQ ID NO: 743214 - DNA, 13 bp, C. elegans
tttgtagtcaaat

SEQ ID NO: 743215 - DNA, 13 bp, C. elegans
tttgtagtcattt

SEQ ID NO: 743216 - DNA, 13 bp, C. elegans
tttgtagtctatt

SEQ ID NO: 743217 - DNA, 13 bp, C. elegans
tttgtagtctctg

SEQ ID NO: 743218 - DNA, 13 bp, C. elegans
tttgtagtcttag

SEQ ID NO: 743219 - DNA, 13 bp, C. elegans
tttgtagtgaaaa

SEQ ID NO: 743220 - DNA, 13 bp, C. elegans
tttgtagttcaaa

SEQ ID NO: 743221 - DNA, 13 bp, C. elegans
tttgtagttgaac

SEQ ID NO: 743222 - DNA, 13 bp, C. elegans
tttgtagtttcag

SEQ ID NO: 743223 - DNA, 13 bp, C. elegans
tttgtagtttcta

SEQ ID NO: 743224 - DNA, 13 bp, C. elegans
tttgtataaaaac

SEQ ID NO: 743225 - DNA, 13 bp, C. elegans
tttgtataatttc

SEQ ID NO: 743226 - DNA, 13 bp, C. elegans
tttgtatacattt

SEQ ID NO: 743227 - DNA, 13 bp, C. elegans
tttgtatcaaaaa

SEQ ID NO: 743228 - DNA, 13 bp, C. elegans
tttgtatcaaaat

SEQ ID NO: 743229 - DNA, 13 bp, C. elegans
tttgtatcaaatt

SEQ ID NO: 743230 - DNA, 13 bp, C. elegans
tttgtatcaatat

SEQ ID NO: 743231 - DNA, 13 bp, C. elegans
tttgtatgtgtaa

SEQ ID NO: 743232 - DNA, 13 bp, C. elegans
tttgtatgttaaa

SEQ ID NO: 743233 - DNA, 13 bp, C. elegans
tttgtattctcaa

SEQ ID NO: 743234 - DNA, 13 bp, C. elegans
tttgtattgaaaa

SEQ ID NO: 743235 - DNA, 13 bp, C. elegans
tttgtattgaata

SEQ ID NO: 743236 - DNA, 13 bp, C. elegans
tttgtatttagaa

SEQ ID NO: 743237 - DNA, 13 bp, C. elegans
tttgtatttcaat

SEQ ID NO: 743238 - DNA, 13 bp, C. elegans
tttgtatttcgaa

SEQ ID NO: 743239 - DNA, 13 bp, C. elegans
tttgtatttctca

SEQ ID NO: 743240 - DNA, 13 bp, C. elegans
tttgtatttgaaa

SEQ ID NO: 743241 - DNA, 14 bp, C. elegans
tttgtatttgaaat

SEQ ID NO: 743242 - DNA, 13 bp, C. elegans
tttgtatttgaag

SEQ ID NO: 743243 - DNA, 13 bp, C. elegans
tttgtatttggaa

SEQ ID NO: 743244 - DNA, 13 bp, C. elegans
tttgtattttaca

SEQ ID NO: 743245 - DNA, 13 bp, C. elegans
tttgtattttcag

SEQ ID NO: 743246 - DNA, 13 bp, C. elegans
tttgtattttcga

SEQ ID NO: 743247 - DNA, 13 bp, C. elegans
tttgtcaaaaatg

SEQ ID NO: 743248 - DNA, 13 bp, C. elegans
tttgtcaaaaatt

SEQ ID NO: 743249 - DNA, 13 bp, C. elegans
tttgtcaaaagtt

SEQ ID NO: 743250 - DNA, 13 bp, C. elegans
tttgtcaaaattc

SEQ ID NO: 743251 - DNA, 13 bp, C. elegans
tttgtcaaattcc

SEQ ID NO: 743252 - DNA, 14 bp, C. elegans
tttgtcaaattttt

SEQ ID NO: 743253 - DNA, 13 bp, C. elegans
tttgtcaacaaaa

SEQ ID NO: 743254 - DNA, 13 bp, C. elegans
tttgtcaacttct

SEQ ID NO: 743255 - DNA, 13 bp, C. elegans
tttgtcaagaaaa

SEQ ID NO: 743256 - DNA, 13 bp, C. elegans
tttgtcaagattt

SEQ ID NO: 743257 - DNA, 13 bp, C. elegans
tttgtcaatttca

SEQ ID NO: 743258 - DNA, 13 bp, C. elegans
tttgtcaatttgc

SEQ ID NO: 743259 - DNA, 13 bp, C. elegans
tttgtcacaaaaa

SEQ ID NO: 743260 - DNA, 13 bp, C. elegans
tttgtcacatttt

SEQ ID NO: 743261 - DNA, 13 bp, C. elegans
tttgtcactattt

SEQ ID NO: 743262 - DNA, 13 bp, C. elegans
tttgtcagaaaaa

SEQ ID NO: 743263 - DNA, 14 bp, C. elegans
tttgtcagaaaatt

SEQ ID NO: 743264 - DNA, 13 bp, C. elegans
tttgtcagaaatt

SEQ ID NO: 743265 - DNA, 13 bp, C. elegans
tttgtcataattt

SEQ ID NO: 743266 - DNA, 13 bp, C. elegans
tttgtcatatttg

SEQ ID NO: 743267 - DNA, 13 bp, C. elegans
tttgtcatcattt

SEQ ID NO: 743268 - DNA, 13 bp, C. elegans
tttgtcatcgaaa

SEQ ID NO: 743269 - DNA, 13 bp, C. elegans
tttgtcatttata

SEQ ID NO: 743270 - DNA, 13 bp, C. elegans
tttgtcattttca

SEQ ID NO: 743271 - DNA, 13 bp, C. elegans
tttgtcattttcg

SEQ ID NO: 743272 - DNA, 13 bp, C. elegans
tttgtccaaaaat

SEQ ID NO: 743273 - DNA, 13 bp, C. elegans
tttgtccaagttt

SEQ ID NO: 743274 - DNA, 13 bp, C. elegans
tttgtccaatttc

SEQ ID NO: 743275 - DNA, 13 bp, C. elegans
tttgtccaatttt

SEQ ID NO: 743276 - DNA, 13 bp, C. elegans
tttgtccagaaaa

SEQ ID NO: 743277 - DNA, 13 bp, C. elegans
tttgtccattctg

SEQ ID NO: 743278 - DNA, 13 bp, C. elegans
tttgtcccatttt

SEQ ID NO: 743279 - DNA, 13 bp, C. elegans
tttgtcgaaaaac

SEQ ID NO: 743280 - DNA, 13 bp, C. elegans
tttgtcgaaaaat

SEQ ID NO: 743281 - DNA, 13 bp, C. elegans
tttgtcgacaaat

SEQ ID NO: 743282 - DNA, 13 bp, C. elegans
tttgtcgagtttt

SEQ ID NO: 743283 - DNA, 13 bp, C. elegans
tttgtcgcaattt

SEQ ID NO: 743284 - DNA, 13 bp, C. elegans
tttgtcgtaattt

SEQ ID NO: 743285 - DNA, 13 bp, C. elegans
tttgtcgtcaaaa

SEQ ID NO: 743286 - DNA, 13 bp, C. elegans
tttgtctaaaata

SEQ ID NO: 743287 - DNA, 13 bp, C. elegans
tttgtctacaaag

SEQ ID NO: 743288 - DNA, 13 bp, C. elegans
tttgtctcaaaaa

SEQ ID NO: 743289 - DNA, 13 bp, C. elegans
tttgtctcaaaag

SEQ ID NO: 743290 - DNA, 13 bp, C. elegans
tttgtctcaattt

SEQ ID NO: 743291 - DNA, 13 bp, C. elegans
tttgtctgaaaat

SEQ ID NO: 743292 - DNA, 13 bp, C. elegans
tttgtctggaaaa

SEQ ID NO: 743293 - DNA, 13 bp, C. elegans
tttgtcttaaaaa

SEQ ID NO: 743294 - DNA, 13 bp, C. elegans
tttgtcttcaaaa

SEQ ID NO: 743295 - DNA, 13 bp, C. elegans
tttgtgaaaaagt

SEQ ID NO: 743296 - DNA, 13 bp, C. elegans
tttgtgaaaaata

SEQ ID NO: 743297 - DNA, 13 bp, C. elegans
tttgtgaaaaatg

SEQ ID NO: 743298 - DNA, 13 bp, C. elegans
tttgtgaaaaatt

SEQ ID NO: 743299 - DNA, 13 bp, C. elegans
tttgtgaaaagaa

SEQ ID NO: 743300 - DNA, 13 bp, C. elegans
tttgtgaaaagtt

SEQ ID NO: 743301 - DNA, 13 bp, C. elegans
tttgtgaaaatat

SEQ ID NO: 743302 - DNA, 13 bp, C. elegans
tttgtgaaaatga

SEQ ID NO: 743303 - DNA, 13 bp, C. elegans
tttgtgaaaattc

SEQ ID NO: 743304 - DNA, 13 bp, C. elegans
tttgtgaaagatt

SEQ ID NO: 743305 - DNA, 13 bp, C. elegans
tttgtgaaattta

SEQ ID NO: 743306 - DNA, 13 bp, C. elegans
tttgtgaaatttc

SEQ ID NO: 743307 - DNA, 13 bp, C. elegans
tttgtgaacactg

SEQ ID NO: 743308 - DNA, 13 bp, C. elegans
tttgtgaacttta

SEQ ID NO: 743309 - DNA, 13 bp, C. elegans
tttgtgaactttg

SEQ ID NO: 743310 - DNA, 13 bp, C. elegans
tttgtgaagaact

SEQ ID NO: 743311 - DNA, 13 bp, C. elegans
tttgtgaataaat

SEQ ID NO: 743312 - DNA, 13 bp, C. elegans
tttgtgaatatat

SEQ ID NO: 743313 - DNA, 13 bp, C. elegans
tttgtgaatattc

SEQ ID NO: 743314 - DNA, 13 bp, C. elegans
tttgtgaatgaat

SEQ ID NO: 743315 - DNA, 13 bp, C. elegans
tttgtgaattaat

SEQ ID NO: 743316 - DNA, 13 bp, C. elegans
tttgtgaatttct

SEQ ID NO: 743317 - DNA, 13 bp, C. elegans
tttgtgacaattg

SEQ ID NO: 743318 - DNA, 13 bp, C. elegans
tttgtgacaattt

SEQ ID NO: 743319 - DNA, 13 bp, C. elegans
tttgtgacgtcac

SEQ ID NO: 743320 - DNA, 13 bp, C. elegans
tttgtgagaaatc

SEQ ID NO: 743321 - DNA, 13 bp, C. elegans
tttgtgagcaaat

SEQ ID NO: 743322 - DNA, 13 bp, C. elegans
tttgtgaggaaat

SEQ ID NO: 743323 - DNA, 13 bp, C. elegans
tttgtgataagaa

SEQ ID NO: 743324 - DNA, 13 bp, C. elegans
tttgtgataattc

SEQ ID NO: 743325 - DNA, 13 bp, C. elegans
tttgtgatatttc

SEQ ID NO: 743326 - DNA, 13 bp, C. elegans
tttgtgatcaaaa

SEQ ID NO: 743327 - DNA, 13 bp, C. elegans
tttgtgatgaatt

SEQ ID NO: 743328 - DNA, 13 bp, C. elegans
tttgtgatgacgt

SEQ ID NO: 743329 - DNA, 13 bp, C. elegans
tttgtgattcata

SEQ ID NO: 743330 - DNA, 13 bp, C. elegans
tttgtgattgaaa

SEQ ID NO: 743331 - DNA, 13 bp, C. elegans
tttgtgatttctg

SEQ ID NO: 743332 - DNA, 13 bp, C. elegans
tttgtgatttgaa

SEQ ID NO: 743333 - DNA, 13 bp, C. elegans
tttgtgcaaaaat

SEQ ID NO: 743334 - DNA, 13 bp, C. elegans
tttgtgcaatttc

SEQ ID NO: 743335 - DNA, 13 bp, C. elegans
tttgtgcacaaat

SEQ ID NO: 743336 - DNA, 13 bp, C. elegans
tttgtgcacaatt

SEQ ID NO: 743337 - DNA, 13 bp, C. elegans
tttgtgcacattt

SEQ ID NO: 743338 - DNA, 13 bp, C. elegans
tttgtgcagaaaa

SEQ ID NO: 743339 - DNA, 13 bp, C. elegans
tttgtgcagtttt

SEQ ID NO: 743340 - DNA, 13 bp, C. elegans
tttgtgcataaaa

SEQ ID NO: 743341 - DNA, 13 bp, C. elegans
tttgtgcatattt

SEQ ID NO: 743342 - DNA, 13 bp, C. elegans
tttgtgcatttta

SEQ ID NO: 743343 - DNA, 13 bp, C. elegans
tttgtgcctgtat

SEQ ID NO: 743344 - DNA, 13 bp, C. elegans
tttgtgctaaaat

SEQ ID NO: 743345 - DNA, 13 bp, C. elegans
tttgtgctcaatt

SEQ ID NO: 743346 - DNA, 13 bp, C. elegans
tttgtgctcattt

SEQ ID NO: 743347 - DNA, 13 bp, C. elegans
tttgtgctccaaa

SEQ ID NO: 743348 - DNA, 13 bp, C. elegans
tttgtgctgaaaa

SEQ ID NO: 743349 - DNA, 13 bp, C. elegans
tttgtggaaaaaa

SEQ ID NO: 743350 - DNA, 13 bp, C. elegans
tttgtggaaaact

SEQ ID NO: 743351 - DNA, 13 bp, C. elegans
tttgtggaaaatt

SEQ ID NO: 743352 - DNA, 13 bp, C. elegans
tttgtggaaactt

SEQ ID NO: 743353 - DNA, 13 bp, C. elegans
tttgtggaaataa

SEQ ID NO: 743354 - DNA, 13 bp, C. elegans
tttgtggaatatt

SEQ ID NO: 743355 - DNA, 13 bp, C. elegans
tttgtggtcaaaa

SEQ ID NO: 743356 - DNA, 14 bp, C. elegans
tttgtggttttcaa

SEQ ID NO: 743357 - DNA, 13 bp, C. elegans
tttgtgtaaaaaa

SEQ ID NO: 743358 - DNA, 13 bp, C. elegans
tttgtgtaaaaac

SEQ ID NO: 743359 - DNA, 13 bp, C. elegans
tttgtgtacattt

SEQ ID NO: 743360 - DNA, 13 bp, C. elegans
tttgtgtagaaaa

SEQ ID NO: 743361 - DNA, 13 bp, C. elegans
tttgtgtcaaaaa

SEQ ID NO: 743362 - DNA, 13 bp, C. elegans
tttgtgtcaattt

SEQ ID NO: 743363 - DNA, 13 bp, C. elegans
tttgtgtccattt

SEQ ID NO: 743364 - DNA, 13 bp, C. elegans
tttgtgtcgaaaa

SEQ ID NO: 743365 - DNA, 13 bp, C. elegans
tttgtgtcgaatt

SEQ ID NO: 743366 - DNA, 13 bp, C. elegans
tttgtgtcgattt

SEQ ID NO: 743367 - DNA, 13 bp, C. elegans
tttgtgtgcaatt

SEQ ID NO: 743368 - DNA, 13 bp, C. elegans
tttgtgtgcagtg

SEQ ID NO: 743369 - DNA, 13 bp, C. elegans
tttgtgtgtaact

SEQ ID NO: 743370 - DNA, 13 bp, C. elegans
tttgtgttaaaat

SEQ ID NO: 743371 - DNA, 13 bp, C. elegans
tttgtgttcaatg

SEQ ID NO: 743372 - DNA, 13 bp, C. elegans
tttgtgttgaaaa

SEQ ID NO: 743373 - DNA, 13 bp, C. elegans
tttgtgttgaaac

SEQ ID NO: 743374 - DNA, 13 bp, C. elegans
tttgtgttggaaa

SEQ ID NO: 743375 - DNA, 13 bp, C. elegans
tttgtgtttgaac

SEQ ID NO: 743376 - DNA, 13 bp, C. elegans
tttgttaaaaact

SEQ ID NO: 743377 - DNA, 13 bp, C. elegans
tttgttaaaaatg

SEQ ID NO: 743378 - DNA, 13 bp, C. elegans
tttgttaaaagaa

SEQ ID NO: 743379 - DNA, 13 bp, C. elegans
tttgttaaaagtt

SEQ ID NO: 743380 - DNA, 13 bp, C. elegans
tttgttaaacttt

SEQ ID NO: 743381 - DNA, 13 bp, C. elegans
tttgttaaagaaa

SEQ ID NO: 743382 - DNA, 13 bp, C. elegans
tttgttaaagatt

SEQ ID NO: 743383 - DNA, 13 bp, C. elegans
tttgttaaatgca

SEQ ID NO: 743384 - DNA, 13 bp, C. elegans
tttgttaaattca

SEQ ID NO: 743385 - DNA, 13 bp, C. elegans
tttgttaactgaa

SEQ ID NO: 743386 - DNA, 13 bp, C. elegans
tttgttacaaaat

SEQ ID NO: 743387 - DNA, 13 bp, C. elegans
tttgttacagttt

SEQ ID NO: 743388 - DNA, 13 bp, C. elegans
tttgttagaaaaa

SEQ ID NO: 743389 - DNA, 13 bp, C. elegans
tttgttatcaaaa

SEQ ID NO: 743390 - DNA, 13 bp, C. elegans
tttgttatcatta

SEQ ID NO: 743391 - DNA, 13 bp, C. elegans
tttgttatggaaa

SEQ ID NO: 743392 - DNA, 13 bp, C. elegans
tttgttcaaaaca

SEQ ID NO: 743393 - DNA, 13 bp, C. elegans
tttgttcaaaact

SEQ ID NO: 743394 - DNA, 13 bp, C. elegans
tttgttcaaaatt

SEQ ID NO: 743395 - DNA, 13 bp, C. elegans
tttgttcaaacaa

SEQ ID NO: 743396 - DNA, 13 bp, C. elegans
tttgttcaaatat

SEQ ID NO: 743397 - DNA, 13 bp, C. elegans
tttgttcaaatct

SEQ ID NO: 743398 - DNA, 13 bp, C. elegans
tttgttcaaatgt

SEQ ID NO: 743399 - DNA, 13 bp, C. elegans
tttgttcaaattc

SEQ ID NO: 743400 - DNA, 13 bp, C. elegans
tttgttcaaattt

SEQ ID NO: 743401 - DNA, 14 bp, C. elegans
tttgttcaaatttt

SEQ ID NO: 743402 - DNA, 13 bp, C. elegans
tttgttcaataaa

SEQ ID NO: 743403 - DNA, 13 bp, C. elegans
tttgttcaatgtt

SEQ ID NO: 743404 - DNA, 13 bp, C. elegans
tttgttcaattta

SEQ ID NO: 743405 - DNA, 13 bp, C. elegans
tttgttcactaaa

SEQ ID NO: 743406 - DNA, 13 bp, C. elegans
tttgttcagaaaa

SEQ ID NO: 743407 - DNA, 13 bp, C. elegans
tttgttcagaaat

SEQ ID NO: 743408 - DNA, 13 bp, C. elegans
tttgttcataaat

SEQ ID NO: 743409 - DNA, 13 bp, C. elegans
tttgttcatttca

SEQ ID NO: 743410 - DNA, 13 bp, C. elegans
tttgttccaaaaa

SEQ ID NO: 743411 - DNA, 13 bp, C. elegans
tttgttccaaaag

SEQ ID NO: 743412 - DNA, 13 bp, C. elegans
tttgttccaagaa

SEQ ID NO: 743413 - DNA, 13 bp, C. elegans
tttgttccaagtt

SEQ ID NO: 743414 - DNA, 13 bp, C. elegans
tttgttccatatt

SEQ ID NO: 743415 - DNA, 13 bp, C. elegans
tttgttcccaaaa

SEQ ID NO: 743416 - DNA, 13 bp, C. elegans
tttgttccgaaat

SEQ ID NO: 743417 - DNA, 13 bp, C. elegans
tttgttccgcaga

SEQ ID NO: 743418 - DNA, 13 bp, C. elegans
tttgttcgaaaaa

SEQ ID NO: 743419 - DNA, 13 bp, C. elegans
tttgttcgaaatt

SEQ ID NO: 743420 - DNA, 13 bp, C. elegans
tttgttcgctgcg

SEQ ID NO: 743421 - DNA, 13 bp, C. elegans
tttgttcggaaaa

SEQ ID NO: 743422 - DNA, 14 bp, C. elegans
tttgttcggtggag

SEQ ID NO: 743423 - DNA, 13 bp, C. elegans
tttgttcgtaaaa

SEQ ID NO: 743424 - DNA, 13 bp, C. elegans
tttgttctgaaaa

SEQ ID NO: 743425 - DNA, 13 bp, C. elegans
tttgttcttatca

SEQ ID NO: 743426 - DNA, 13 bp, C. elegans
tttgttcttcaat

SEQ ID NO: 743427 - DNA, 13 bp, C. elegans
tttgttcttgaat

SEQ ID NO: 743428 - DNA, 13 bp, C. elegans
tttgttctttcaa

SEQ ID NO: 743429 - DNA, 13 bp, C. elegans
tttgttgaaaaaa

SEQ ID NO: 743430 - DNA, 14 bp, C. elegans
tttgttgaaaaaaa

SEQ ID NO: 743431 - DNA, 13 bp, C. elegans
tttgttgaaaaac

SEQ ID NO: 743432 - DNA, 13 bp, C. elegans
tttgttgaaaaag

SEQ ID NO: 743433 - DNA, 13 bp, C. elegans
tttgttgaaaaga

SEQ ID NO: 743434 - DNA, 13 bp, C. elegans
tttgttgaaaagt

SEQ ID NO: 743435 - DNA, 13 bp, C. elegans
tttgttgaaataa

SEQ ID NO: 743436 - DNA, 13 bp, C. elegans
tttgttgaagtgg

SEQ ID NO: 743437 - DNA, 13 bp, C. elegans
tttgttgaataat

SEQ ID NO: 743438 - DNA, 13 bp, C. elegans
tttgttgaattca

SEQ ID NO: 743439 - DNA, 13 bp, C. elegans
tttgttgacaatt

SEQ ID NO: 743440 - DNA, 13 bp, C. elegans
tttgttgagaaaa

SEQ ID NO: 743441 - DNA, 13 bp, C. elegans
tttgttgatgaaa

SEQ ID NO: 743442 - DNA, 13 bp, C. elegans
tttgttgcaaaac

SEQ ID NO: 743443 - DNA, 13 bp, C. elegans
tttgttgcaaact

SEQ ID NO: 743444 - DNA, 13 bp, C. elegans
tttgttgcaaatg

SEQ ID NO: 743445 - DNA, 13 bp, C. elegans
tttgttgcaatat

SEQ ID NO: 743446 - DNA, 13 bp, C. elegans
tttgttgcaattt

SEQ ID NO: 743447 - DNA, 13 bp, C. elegans
tttgttgcacatt

SEQ ID NO: 743448 - DNA, 13 bp, C. elegans
tttgttgcatatt

SEQ ID NO: 743449 - DNA, 13 bp, C. elegans
tttgttgctattg

SEQ ID NO: 743450 - DNA, 13 bp, C. elegans
tttgttgctttca

SEQ ID NO: 743451 - DNA, 13 bp, C. elegans
tttgttggaaaaa

SEQ ID NO: 743452 - DNA, 13 bp, C. elegans
tttgttggaaatg

SEQ ID NO: 743453 - DNA, 14 bp, C. elegans
tttgttggaaattc

SEQ ID NO: 743454 - DNA, 13 bp, C. elegans
tttgttggcaaaa

SEQ ID NO: 743455 - DNA, 13 bp, C. elegans
tttgttgtgaata

SEQ ID NO: 743456 - DNA, 13 bp, C. elegans
tttgtttaaaatc

SEQ ID NO: 743457 - DNA, 13 bp, C. elegans
tttgtttagtaaa

SEQ ID NO: 743458 - DNA, 13 bp, C. elegans
tttgtttatcaaa

SEQ ID NO: 743459 - DNA, 13 bp, C. elegans
tttgtttattcga

SEQ ID NO: 743460 - DNA, 13 bp, C. elegans
tttgtttcaaaaa

SEQ ID NO: 743461 - DNA, 13 bp, C. elegans
tttgtttcaaatg

SEQ ID NO: 743462 - DNA, 13 bp, C. elegans
tttgtttcaataa

SEQ ID NO: 743463 - DNA, 13 bp, C. elegans
tttgtttcaatgt

SEQ ID NO: 743464 - DNA, 13 bp, C. elegans
tttgtttcataat

SEQ ID NO: 743465 - DNA, 13 bp, C. elegans
tttgtttccaaaa

SEQ ID NO: 743466 - DNA, 13 bp, C. elegans
tttgtttccatct

SEQ ID NO: 743467 - DNA, 13 bp, C. elegans
tttgtttcgaaaa

SEQ ID NO: 743468 - DNA, 13 bp, C. elegans
tttgtttctaaaa

SEQ ID NO: 743469 - DNA, 13 bp, C. elegans
tttgtttctaaat

SEQ ID NO: 743470 - DNA, 13 bp, C. elegans
tttgtttctagaa

SEQ ID NO: 743471 - DNA, 13 bp, C. elegans
tttgtttctcact

SEQ ID NO: 743472 - DNA, 13 bp, C. elegans
tttgtttctgaaa

SEQ ID NO: 743473 - DNA, 13 bp, C. elegans
tttgtttcttaaa

SEQ ID NO: 743474 - DNA, 13 bp, C. elegans
tttgtttgaaaaa

SEQ ID NO: 743475 - DNA, 13 bp, C. elegans
tttgtttgaaaac

SEQ ID NO: 743476 - DNA, 13 bp, C. elegans
tttgtttgcagaa

SEQ ID NO: 743477 - DNA, 14 bp, C. elegans
tttgtttgtaaaaa

SEQ ID NO: 743478 - DNA, 13 bp, C. elegans
tttgtttgtgaaa

SEQ ID NO: 743479 - DNA, 13 bp, C. elegans
tttgttttaagaa

SEQ ID NO: 743480 - DNA, 13 bp, C. elegans
tttgttttatcac

SEQ ID NO: 743481 - DNA, 13 bp, C. elegans
tttgttttcaaat

SEQ ID NO: 743482 - DNA, 13 bp, C. elegans
tttgttttcaaga

SEQ ID NO: 743483 - DNA, 14 bp, C. elegans
tttgttttcaataa

SEQ ID NO: 743484 - DNA, 13 bp, C. elegans
tttgttttcataa

SEQ ID NO: 743485 - DNA, 13 bp, C. elegans
tttgttttgaaaa

SEQ ID NO: 743486 - DNA, 13 bp, C. elegans
tttgttttgagaa

SEQ ID NO: 743487 - DNA, 13 bp, C. elegans
tttgttttggaaa

SEQ ID NO: 743488 - DNA, 13 bp, C. elegans
tttgttttggaag

SEQ ID NO: 743489 - DNA, 13 bp, C. elegans
tttgtttttgaca

SEQ ID NO: 743490 - DNA, 13 bp, C. elegans
tttgtttttgcca

SEQ ID NO: 743491 - DNA, 13 bp, C. elegans
ttttaaaaaactc

SEQ ID NO: 743492 - DNA, 13 bp, C. elegans
ttttaaaaaactg

SEQ ID NO: 743493 - DNA, 13 bp, C. elegans
ttttaaaaaatcc

SEQ ID NO: 743494 - DNA, 13 bp, C. elegans
ttttaaaaaatgc

SEQ ID NO: 743495 - DNA, 13 bp, C. elegans
ttttaaaaacatg

SEQ ID NO: 743496 - DNA, 13 bp, C. elegans
ttttaaaaactca

SEQ ID NO: 743497 - DNA, 13 bp, C. elegans
ttttaaaaactct

SEQ ID NO: 743498 - DNA, 13 bp, C. elegans
ttttaaaaatccc

SEQ ID NO: 743499 - DNA, 13 bp, C. elegans
ttttaaaaatcga

SEQ ID NO: 743500 - DNA, 13 bp, C. elegans
ttttaaaacactt

SEQ ID NO: 743501 - DNA, 13 bp, C. elegans
ttttaaaacatca

SEQ ID NO: 743502 - DNA, 13 bp, C. elegans
ttttaaaactaac

SEQ ID NO: 743503 - DNA, 13 bp, C. elegans
ttttaaaactcta

SEQ ID NO: 743504 - DNA, 13 bp, C. elegans
ttttaaaactgta

SEQ ID NO: 743505 - DNA, 13 bp, C. elegans
ttttaaaacttga

SEQ ID NO: 743506 - DNA, 13 bp, C. elegans
ttttaaaagaaca

SEQ ID NO: 743507 - DNA, 13 bp, C. elegans
ttttaaaagatgt

SEQ ID NO: 743508 - DNA, 13 bp, C. elegans
ttttaaaagcaac

SEQ ID NO: 743509 - DNA, 13 bp, C. elegans
ttttaaaagcaat

SEQ ID NO: 743510 - DNA, 13 bp, C. elegans
ttttaaaagtgat

SEQ ID NO: 743511 - DNA, 13 bp, C. elegans
ttttaaaagttcc

SEQ ID NO: 743512 - DNA, 13 bp, C. elegans
ttttaaaagttgt

SEQ ID NO: 743513 - DNA, 13 bp, C. elegans
ttttaaaatcgaa

SEQ ID NO: 743514 - DNA, 13 bp, C. elegans
ttttaaaatcttc

SEQ ID NO: 743515 - DNA, 13 bp, C. elegans
ttttaaaatgcta

SEQ ID NO: 743516 - DNA, 13 bp, C. elegans
ttttaaaatggaa

SEQ ID NO: 743517 - DNA, 13 bp, C. elegans
ttttaaaatggct

SEQ ID NO: 743518 - DNA, 13 bp, C. elegans
ttttaaaatggtt

SEQ ID NO: 743519 - DNA, 13 bp, C. elegans
ttttaaaatgtag

SEQ ID NO: 743520 - DNA, 13 bp, C. elegans
ttttaaaattcag

SEQ ID NO: 743521 - DNA, 13 bp, C. elegans
ttttaaaattctc

SEQ ID NO: 743522 - DNA, 13 bp, C. elegans
ttttaaaattgtg

SEQ ID NO: 743523 - DNA, 13 bp, C. elegans
ttttaaacagttt

SEQ ID NO: 743524 - DNA, 13 bp, C. elegans
ttttaaaccagtt

SEQ ID NO: 743525 - DNA, 13 bp, C. elegans
ttttaaaccgaga

SEQ ID NO: 743526 - DNA, 13 bp, C. elegans
ttttaaaccgatt

SEQ ID NO: 743527 - DNA, 13 bp, C. elegans
ttttaaacgattt

SEQ ID NO: 743528 - DNA, 13 bp, C. elegans
ttttaaacgtttt

SEQ ID NO: 743529 - DNA, 13 bp, C. elegans
ttttaaactagaa

SEQ ID NO: 743530 - DNA, 13 bp, C. elegans
ttttaaactcaaa

SEQ ID NO: 743531 - DNA, 13 bp, C. elegans
ttttaaactgtat

SEQ ID NO: 743532 - DNA, 13 bp, C. elegans
ttttaaactttga

SEQ ID NO: 743533 - DNA, 13 bp, C. elegans
ttttaaacttttg

SEQ ID NO: 743534 - DNA, 13 bp, C. elegans
ttttaaagaagaa

SEQ ID NO: 743535 - DNA, 13 bp, C. elegans
ttttaaagaagat

SEQ ID NO: 743536 - DNA, 13 bp, C. elegans
ttttaaagatgga

SEQ ID NO: 743537 - DNA, 13 bp, C. elegans
ttttaaagcaaat

SEQ ID NO: 743538 - DNA, 13 bp, C. elegans
ttttaaagctaaa

SEQ ID NO: 743539 - DNA, 13 bp, C. elegans
ttttaaagctctc

SEQ ID NO: 743540 - DNA, 13 bp, C. elegans
ttttaaagctttc

SEQ ID NO: 743541 - DNA, 13 bp, C. elegans
ttttaaagctttt

SEQ ID NO: 743542 - DNA, 13 bp, C. elegans
ttttaaaggaaaa

SEQ ID NO: 743543 - DNA, 13 bp, C. elegans
ttttaaaggaata

SEQ ID NO: 743544 - DNA, 13 bp, C. elegans
ttttaaaggttga

SEQ ID NO: 743545 - DNA, 13 bp, C. elegans
ttttaaagtacaa

SEQ ID NO: 743546 - DNA, 13 bp, C. elegans
ttttaaagtactt

SEQ ID NO: 743547 - DNA, 13 bp, C. elegans
ttttaaagtcaaa

SEQ ID NO: 743548 - DNA, 13 bp, C. elegans
ttttaaagtcaat

SEQ ID NO: 743549 - DNA, 13 bp, C. elegans
ttttaaagtcatt

SEQ ID NO: 743550 - DNA, 13 bp, C. elegans
ttttaaagtttct

SEQ ID NO: 743551 - DNA, 13 bp, C. elegans
ttttaaagtttga

SEQ ID NO: 743552 - DNA, 13 bp, C. elegans
ttttaaatacgaa

SEQ ID NO: 743553 - DNA, 13 bp, C. elegans
ttttaaatattcg

SEQ ID NO: 743554 - DNA, 13 bp, C. elegans
ttttaaatcaaga

SEQ ID NO: 743555 - DNA, 13 bp, C. elegans
ttttaaatcaatc

SEQ ID NO: 743556 - DNA, 13 bp, C. elegans
ttttaaatccaaa

SEQ ID NO: 743557 - DNA, 13 bp, C. elegans
ttttaaatcgaaa

SEQ ID NO: 743558 - DNA, 13 bp, C. elegans
ttttaaatctgga

SEQ ID NO: 743559 - DNA, 13 bp, C. elegans
ttttaaatgactc

SEQ ID NO: 743560 - DNA, 13 bp, C. elegans
ttttaaatgcata

SEQ ID NO: 743561 - DNA, 13 bp, C. elegans
ttttaaatgcatt

SEQ ID NO: 743562 - DNA, 13 bp, C. elegans
ttttaaatgctca

SEQ ID NO: 743563 - DNA, 13 bp, C. elegans
ttttaaatggaaa

SEQ ID NO: 743564 - DNA, 13 bp, C. elegans
ttttaaatggtta

SEQ ID NO: 743565 - DNA, 13 bp, C. elegans
ttttaaatgtatc

SEQ ID NO: 743566 - DNA, 13 bp, C. elegans
ttttaaatgtcat

SEQ ID NO: 743567 - DNA, 13 bp, C. elegans
ttttaaatgttac

SEQ ID NO: 743568 - DNA, 13 bp, C. elegans
ttttaaatgttca

SEQ ID NO: 743569 - DNA, 13 bp, C. elegans
ttttaaatgtttc

SEQ ID NO: 743570 - DNA, 13 bp, C. elegans
ttttaaattctgt

SEQ ID NO: 743571 - DNA, 13 bp, C. elegans
ttttaaattgtct

SEQ ID NO: 743572 - DNA, 13 bp, C. elegans
ttttaaatttccg

SEQ ID NO: 743573 - DNA, 13 bp, C. elegans
ttttaaatttcga

SEQ ID NO: 743574 - DNA, 13 bp, C. elegans
ttttaaattttcg

SEQ ID NO: 743575 - DNA, 13 bp, C. elegans
ttttaacaaatgt

SEQ ID NO: 743576 - DNA, 13 bp, C. elegans
ttttaacaacttc

SEQ ID NO: 743577 - DNA, 13 bp, C. elegans
ttttaacaacttt

SEQ ID NO: 743578 - DNA, 13 bp, C. elegans
ttttaacaatttc

SEQ ID NO: 743579 - DNA, 13 bp, C. elegans
ttttaacaatttg

SEQ ID NO: 743580 - DNA, 13 bp, C. elegans
ttttaacacgaaa

SEQ ID NO: 743581 - DNA, 13 bp, C. elegans
ttttaacacttta

SEQ ID NO: 743582 - DNA, 13 bp, C. elegans
ttttaacagtgaa

SEQ ID NO: 743583 - DNA, 13 bp, C. elegans
ttttaacagtttt

SEQ ID NO: 743584 - DNA, 13 bp, C. elegans
ttttaacatgttt

SEQ ID NO: 743585 - DNA, 13 bp, C. elegans
ttttaaccaaaaa

SEQ ID NO: 743586 - DNA, 13 bp, C. elegans
ttttaaccaattt

SEQ ID NO: 743587 - DNA, 13 bp, C. elegans
ttttaaccttaaa

SEQ ID NO: 743588 - DNA, 13 bp, C. elegans
ttttaacgatttt

SEQ ID NO: 743589 - DNA, 13 bp, C. elegans
ttttaacggaaaa

SEQ ID NO: 743590 - DNA, 13 bp, C. elegans
ttttaacggaaat

SEQ ID NO: 743591 - DNA, 13 bp, C. elegans
ttttaacggattt

SEQ ID NO: 743592 - DNA, 13 bp, C. elegans
ttttaacgttttg

SEQ ID NO: 743593 - DNA, 13 bp, C. elegans
ttttaactatcaa

SEQ ID NO: 743594 - DNA, 13 bp, C. elegans
ttttaactgaaaa

SEQ ID NO: 743595 - DNA, 13 bp, C. elegans
ttttaactgattt

SEQ ID NO: 743596 - DNA, 13 bp, C. elegans
ttttaactggaaa

SEQ ID NO: 743597 - DNA, 13 bp, C. elegans
ttttaactgtgat

SEQ ID NO: 743598 - DNA, 13 bp, C. elegans
ttttaacttcaaa

SEQ ID NO: 743599 - DNA, 13 bp, C. elegans
ttttaacttgtaa

SEQ ID NO: 743600 - DNA, 13 bp, C. elegans
ttttaagaaaaac

SEQ ID NO: 743601 - DNA, 13 bp, C. elegans
ttttaagaaatcg

SEQ ID NO: 743602 - DNA, 13 bp, C. elegans
ttttaagaatgtt

SEQ ID NO: 743603 - DNA, 13 bp, C. elegans
ttttaagactttt

SEQ ID NO: 743604 - DNA, 13 bp, C. elegans
ttttaagatcaaa

SEQ ID NO: 743605 - DNA, 13 bp, C. elegans
ttttaagatgaat

SEQ ID NO: 743606 - DNA, 13 bp, C. elegans
ttttaagatttga

SEQ ID NO: 743607 - DNA, 13 bp, C. elegans
ttttaagatttgg

SEQ ID NO: 743608 - DNA, 13 bp, C. elegans
ttttaagcaaaaa

SEQ ID NO: 743609 - DNA, 13 bp, C. elegans
ttttaagcaaatt

SEQ ID NO: 743610 - DNA, 13 bp, C. elegans
ttttaagcatttt

SEQ ID NO: 743611 - DNA, 13 bp, C. elegans
ttttaagccaaat

SEQ ID NO: 743612 - DNA, 13 bp, C. elegans
ttttaagccatct

SEQ ID NO: 743613 - DNA, 13 bp, C. elegans
ttttaagcgtttt

SEQ ID NO: 743614 - DNA, 13 bp, C. elegans
ttttaagctagaa

SEQ ID NO: 743615 - DNA, 13 bp, C. elegans
ttttaagctcatt

SEQ ID NO: 743616 - DNA, 13 bp, C. elegans
ttttaagctttca

SEQ ID NO: 743617 - DNA, 13 bp, C. elegans
ttttaagctttct

SEQ ID NO: 743618 - DNA, 13 bp, C. elegans
ttttaagctttta

SEQ ID NO: 743619 - DNA, 13 bp, C. elegans
ttttaagcttttc

SEQ ID NO: 743620 - DNA, 13 bp, C. elegans
ttttaaggaaact

SEQ ID NO: 743621 - DNA, 13 bp, C. elegans
ttttaaggtctcg

SEQ ID NO: 743622 - DNA, 13 bp, C. elegans
ttttaagttcaat

SEQ ID NO: 743623 - DNA, 13 bp, C. elegans
ttttaataaacct

SEQ ID NO: 743624 - DNA, 13 bp, C. elegans
ttttaatacacaa

SEQ ID NO: 743625 - DNA, 13 bp, C. elegans
ttttaatacgaat

SEQ ID NO: 743626 - DNA, 13 bp, C. elegans
ttttaatagttca

SEQ ID NO: 743627 - DNA, 13 bp, C. elegans
ttttaatattcca

SEQ ID NO: 743628 - DNA, 13 bp, C. elegans
ttttaatattcga

SEQ ID NO: 743629 - DNA, 13 bp, C. elegans
ttttaatcacaat

SEQ ID NO: 743630 - DNA, 13 bp, C. elegans
ttttaatcatcaa

SEQ ID NO: 743631 - DNA, 13 bp, C. elegans
ttttaatcatgaa

SEQ ID NO: 743632 - DNA, 13 bp, C. elegans
ttttaatccaagt

SEQ ID NO: 743633 - DNA, 13 bp, C. elegans
ttttaatccaatt

SEQ ID NO: 743634 - DNA, 13 bp, C. elegans
ttttaatcgataa

SEQ ID NO: 743635 - DNA, 13 bp, C. elegans
ttttaatcggaaa

SEQ ID NO: 743636 - DNA, 13 bp, C. elegans
ttttaatctcaaa

SEQ ID NO: 743637 - DNA, 13 bp, C. elegans
ttttaatctgaaa

SEQ ID NO: 743638 - DNA, 13 bp, C. elegans
ttttaatcttcaa

SEQ ID NO: 743639 - DNA, 13 bp, C. elegans
ttttaatcttgaa

SEQ ID NO: 743640 - DNA, 13 bp, C. elegans
ttttaatgaaaca

SEQ ID NO: 743641 - DNA, 13 bp, C. elegans
ttttaatgaagtt

SEQ ID NO: 743642 - DNA, 13 bp, C. elegans
ttttaatgacaaa

SEQ ID NO: 743643 - DNA, 13 bp, C. elegans
ttttaatgatcaa

SEQ ID NO: 743644 - DNA, 13 bp, C. elegans
ttttaatgatgaa

SEQ ID NO: 743645 - DNA, 13 bp, C. elegans
ttttaatgcaatt

SEQ ID NO: 743646 - DNA, 13 bp, C. elegans
ttttaatgcatgt

SEQ ID NO: 743647 - DNA, 13 bp, C. elegans
ttttaatgctgaa

SEQ ID NO: 743648 - DNA, 13 bp, C. elegans
ttttaatgcttca

SEQ ID NO: 743649 - DNA, 13 bp, C. elegans
ttttaatgcttta

SEQ ID NO: 743650 - DNA, 13 bp, C. elegans
ttttaatggaaat

SEQ ID NO: 743651 - DNA, 13 bp, C. elegans
ttttaatggaatt

SEQ ID NO: 743652 - DNA, 13 bp, C. elegans
ttttaatggcttt

SEQ ID NO: 743653 - DNA, 13 bp, C. elegans
ttttaatgtaaga

SEQ ID NO: 743654 - DNA, 13 bp, C. elegans
ttttaatgtcatt

SEQ ID NO: 743655 - DNA, 13 bp, C. elegans
ttttaatgttcta

SEQ ID NO: 743656 - DNA, 13 bp, C. elegans
ttttaattcaaca

SEQ ID NO: 743657 - DNA, 13 bp, C. elegans
ttttaattcaact

SEQ ID NO: 743658 - DNA, 13 bp, C. elegans
ttttaattcccgc

SEQ ID NO: 743659 - DNA, 13 bp, C. elegans
ttttaattcgata

SEQ ID NO: 743660 - DNA, 13 bp, C. elegans
ttttaattgaaac

SEQ ID NO: 743661 - DNA, 13 bp, C. elegans
ttttaattgtaag

SEQ ID NO: 743662 - DNA, 13 bp, C. elegans
ttttaattgtcaa

SEQ ID NO: 743663 - DNA, 13 bp, C. elegans
ttttaatttcaag

SEQ ID NO: 743664 - DNA, 13 bp, C. elegans
ttttaatttccaa

SEQ ID NO: 743665 - DNA, 13 bp, C. elegans
ttttaatttcccc

SEQ ID NO: 743666 - DNA, 13 bp, C. elegans
ttttaatttcccg

SEQ ID NO: 743667 - DNA, 13 bp, C. elegans
ttttaatttctcg

SEQ ID NO: 743668 - DNA, 13 bp, C. elegans
ttttaatttgtgc

SEQ ID NO: 743669 - DNA, 13 bp, C. elegans
ttttaattttcgc

SEQ ID NO: 743670 - DNA, 13 bp, C. elegans
ttttaattttgac

SEQ ID NO: 743671 - DNA, 13 bp, C. elegans
ttttacaaaaaac

SEQ ID NO: 743672 - DNA, 13 bp, C. elegans
ttttacaaaaact

SEQ ID NO: 743673 - DNA, 13 bp, C. elegans
ttttacaaaaaga

SEQ ID NO: 743674 - DNA, 13 bp, C. elegans
ttttacaaaaatg

SEQ ID NO: 743675 - DNA, 13 bp, C. elegans
ttttacaaaacaa

SEQ ID NO: 743676 - DNA, 13 bp, C. elegans
ttttacaaaactc

SEQ ID NO: 743677 - DNA, 13 bp, C. elegans
ttttacaaaagaa

SEQ ID NO: 743678 - DNA, 13 bp, C. elegans
ttttacaaacttt

SEQ ID NO: 743679 - DNA, 13 bp, C. elegans
ttttacaaagaaa

SEQ ID NO: 743680 - DNA, 13 bp, C. elegans
ttttacaaatcag

SEQ ID NO: 743681 - DNA, 13 bp, C. elegans
ttttacaacaaaa

SEQ ID NO: 743682 - DNA, 13 bp, C. elegans
ttttacaacaatt

SEQ ID NO: 743683 - DNA, 13 bp, C. elegans
ttttacaaccaat

SEQ ID NO: 743684 - DNA, 13 bp, C. elegans
ttttacaactaaa

SEQ ID NO: 743685 - DNA, 13 bp, C. elegans
ttttacaacttaa

SEQ ID NO: 743686 - DNA, 13 bp, C. elegans
ttttacaactttc

SEQ ID NO: 743687 - DNA, 13 bp, C. elegans
ttttacaagaaag

SEQ ID NO: 743688 - DNA, 13 bp, C. elegans
ttttacaagaaat

SEQ ID NO: 743689 - DNA, 13 bp, C. elegans
ttttacaaggaaa

SEQ ID NO: 743690 - DNA, 13 bp, C. elegans
ttttacaagtatt

SEQ ID NO: 743691 - DNA, 13 bp, C. elegans
ttttacaagtttt

SEQ ID NO: 743692 - DNA, 13 bp, C. elegans
ttttacaatgttt

SEQ ID NO: 743693 - DNA, 13 bp, C. elegans
ttttacaatttga

SEQ ID NO: 743694 - DNA, 13 bp, C. elegans
ttttacaatttgt

SEQ ID NO: 743695 - DNA, 13 bp, C. elegans
ttttacacaattt

SEQ ID NO: 743696 - DNA, 13 bp, C. elegans
ttttacacacttt

SEQ ID NO: 743697 - DNA, 13 bp, C. elegans
ttttacacagaaa

SEQ ID NO: 743698 - DNA, 13 bp, C. elegans
ttttacacatttc

SEQ ID NO: 743699 - DNA, 13 bp, C. elegans
ttttacaccaaaa

SEQ ID NO: 743700 - DNA, 13 bp, C. elegans
ttttacaccaatt

SEQ ID NO: 743701 - DNA, 13 bp, C. elegans
ttttacacgtttt

SEQ ID NO: 743702 - DNA, 13 bp, C. elegans
ttttacagaaatt

SEQ ID NO: 743703 - DNA, 13 bp, C. elegans
ttttacagaagaa

SEQ ID NO: 743704 - DNA, 13 bp, C. elegans
ttttacagacttt

SEQ ID NO: 743705 - DNA, 13 bp, C. elegans
ttttacagctatg

SEQ ID NO: 743706 - DNA, 13 bp, C. elegans
ttttacagctgaa

SEQ ID NO: 743707 - DNA, 13 bp, C. elegans
ttttacagctttt

SEQ ID NO: 743708 - DNA, 13 bp, C. elegans
ttttacaggtttt

SEQ ID NO: 743709 - DNA, 13 bp, C. elegans
ttttacagtaaaa

SEQ ID NO: 743710 - DNA, 13 bp, C. elegans
ttttacagtacaa

SEQ ID NO: 743711 - DNA, 13 bp, C. elegans
ttttacagtagaa

SEQ ID NO: 743712 - DNA, 13 bp, C. elegans
ttttacagttatt

SEQ ID NO: 743713 - DNA, 13 bp, C. elegans
ttttacagtttca

SEQ ID NO: 743714 - DNA, 13 bp, C. elegans
ttttacagttttc

SEQ ID NO: 743715 - DNA, 13 bp, C. elegans
ttttacatcaaaa

SEQ ID NO: 743716 - DNA, 13 bp, C. elegans
ttttacatcaatt

SEQ ID NO: 743717 - DNA, 13 bp, C. elegans
ttttacatgaaaa

SEQ ID NO: 743718 - DNA, 13 bp, C. elegans
ttttacatgttaa

SEQ ID NO: 743719 - DNA, 13 bp, C. elegans
ttttacattgaaa

SEQ ID NO: 743720 - DNA, 13 bp, C. elegans
ttttacattgacc

SEQ ID NO: 743721 - DNA, 13 bp, C. elegans
ttttacatttgta

SEQ ID NO: 743722 - DNA, 13 bp, C. elegans
ttttaccaaaaaa

SEQ ID NO: 743723 - DNA, 13 bp, C. elegans
ttttaccaaaaca

SEQ ID NO: 743724 - DNA, 13 bp, C. elegans
ttttaccaaaatt

SEQ ID NO: 743725 - DNA, 13 bp, C. elegans
ttttaccaaatcg

SEQ ID NO: 743726 - DNA, 13 bp, C. elegans
ttttaccacaaaa

SEQ ID NO: 743727 - DNA, 13 bp, C. elegans
ttttaccataatt

SEQ ID NO: 743728 - DNA, 13 bp, C. elegans
ttttaccgaaaaa

SEQ ID NO: 743729 - DNA, 13 bp, C. elegans
ttttaccgaaaat

SEQ ID NO: 743730 - DNA, 13 bp, C. elegans
ttttaccggtttt

SEQ ID NO: 743731 - DNA, 13 bp, C. elegans
ttttaccgttgaa

SEQ ID NO: 743732 - DNA, 13 bp, C. elegans
ttttacctaaaaa

SEQ ID NO: 743733 - DNA, 13 bp, C. elegans
ttttacgaaaaaa

SEQ ID NO: 743734 - DNA, 13 bp, C. elegans
ttttacgaaaatt

SEQ ID NO: 743735 - DNA, 13 bp, C. elegans
ttttacgaaattt

SEQ ID NO: 743736 - DNA, 13 bp, C. elegans
ttttacgaacttt

SEQ ID NO: 743737 - DNA, 13 bp, C. elegans
ttttacgaatttt

SEQ ID NO: 743738 - DNA, 14 bp, C. elegans
ttttacgacatttt

SEQ ID NO: 743739 - DNA, 13 bp, C. elegans
ttttacgcaattt

SEQ ID NO: 743740 - DNA, 13 bp, C. elegans
ttttacgcatttt

SEQ ID NO: 743741 - DNA, 13 bp, C. elegans
ttttacggaaaac

SEQ ID NO: 743742 - DNA, 13 bp, C. elegans
ttttacggaaaat

SEQ ID NO: 743743 - DNA, 13 bp, C. elegans
ttttacgggaaaa

SEQ ID NO: 743744 - DNA, 13 bp, C. elegans
ttttacgggaaat

SEQ ID NO: 743745 - DNA, 13 bp, C. elegans
ttttacgggtttt

SEQ ID NO: 743746 - DNA, 13 bp, C. elegans
ttttacggtttca

SEQ ID NO: 743747 - DNA, 13 bp, C. elegans
ttttacggtttta

SEQ ID NO: 743748 - DNA, 13 bp, C. elegans
ttttacgttaaaa

SEQ ID NO: 743749 - DNA, 13 bp, C. elegans
ttttactcaaaaa

SEQ ID NO: 743750 - DNA, 13 bp, C. elegans
ttttactcatcca

SEQ ID NO: 743751 - DNA, 13 bp, C. elegans
ttttactcgaaaa

SEQ ID NO: 743752 - DNA, 13 bp, C. elegans
ttttactctctgt

SEQ ID NO: 743753 - DNA, 13 bp, C. elegans
ttttactctgaaa

SEQ ID NO: 743754 - DNA, 13 bp, C. elegans
ttttactctgaat

SEQ ID NO: 743755 - DNA, 13 bp, C. elegans
ttttactgaaaaa

SEQ ID NO: 743756 - DNA, 13 bp, C. elegans
ttttactgaaaat

SEQ ID NO: 743757 - DNA, 13 bp, C. elegans
ttttactgacttt

SEQ ID NO: 743758 - DNA, 13 bp, C. elegans
ttttactgcaaaa

SEQ ID NO: 743759 - DNA, 13 bp, C. elegans
ttttactggaaaa

SEQ ID NO: 743760 - DNA, 13 bp, C. elegans
ttttactgtttca

SEQ ID NO: 743761 - DNA, 13 bp, C. elegans
ttttacttgaaaa

SEQ ID NO: 743762 - DNA, 13 bp, C. elegans
ttttacttgataa

SEQ ID NO: 743763 - DNA, 13 bp, C. elegans
ttttactttcgaa

SEQ ID NO: 743764 - DNA, 13 bp, C. elegans
ttttagaaaaaga

SEQ ID NO: 743765 - DNA, 13 bp, C. elegans
ttttagaaaaatg

SEQ ID NO: 743766 - DNA, 13 bp, C. elegans
ttttagaaaacaa

SEQ ID NO: 743767 - DNA, 13 bp, C. elegans
ttttagaaaagca

SEQ ID NO: 743768 - DNA, 13 bp, C. elegans
ttttagaaaatgt

SEQ ID NO: 743769 - DNA, 13 bp, C. elegans
ttttagaaaattg

SEQ ID NO: 743770 - DNA, 13 bp, C. elegans
ttttagaaacaaa

SEQ ID NO: 743771 - DNA, 13 bp, C. elegans
ttttagaaacttt

SEQ ID NO: 743772 - DNA, 13 bp, C. elegans
ttttagaaatcaa

SEQ ID NO: 743773 - DNA, 13 bp, C. elegans
ttttagaaatcgt

SEQ ID NO: 743774 - DNA, 13 bp, C. elegans
ttttagaaatcta

SEQ ID NO: 743775 - DNA, 13 bp, C. elegans
ttttagaaatgaa

SEQ ID NO: 743776 - DNA, 13 bp, C. elegans
ttttagaaattac

SEQ ID NO: 743777 - DNA, 13 bp, C. elegans
ttttagaaattca

SEQ ID NO: 743778 - DNA, 13 bp, C. elegans
ttttagaaattcc

SEQ ID NO: 743779 - DNA, 13 bp, C. elegans
ttttagaacgttc

SEQ ID NO: 743780 - DNA, 13 bp, C. elegans
ttttagaagaaaa

SEQ ID NO: 743781 - DNA, 13 bp, C. elegans
ttttagaagcaat

SEQ ID NO: 743782 - DNA, 13 bp, C. elegans
ttttagaatagtt

SEQ ID NO: 743783 - DNA, 13 bp, C. elegans
ttttagaatatca

SEQ ID NO: 743784 - DNA, 13 bp, C. elegans
ttttagaatcaat

SEQ ID NO: 743785 - DNA, 13 bp, C. elegans
ttttagaatcaga

SEQ ID NO: 743786 - DNA, 13 bp, C. elegans
ttttagaatgatt

SEQ ID NO: 743787 - DNA, 13 bp, C. elegans
ttttagaattcaa

SEQ ID NO: 743788 - DNA, 13 bp, C. elegans
ttttagaattcat

SEQ ID NO: 743789 - DNA, 13 bp, C. elegans
ttttagacaaaaa

SEQ ID NO: 743790 - DNA, 13 bp, C. elegans
ttttagacaaaat

SEQ ID NO: 743791 - DNA, 13 bp, C. elegans
ttttagacaattt

SEQ ID NO: 743792 - DNA, 13 bp, C. elegans
ttttagacattta

SEQ ID NO: 743793 - DNA, 13 bp, C. elegans
ttttagacatttt

SEQ ID NO: 743794 - DNA, 13 bp, C. elegans
ttttagaccaaaa

SEQ ID NO: 743795 - DNA, 13 bp, C. elegans
ttttagaccaatt

SEQ ID NO: 743796 - DNA, 13 bp, C. elegans
ttttagacgaatt

SEQ ID NO: 743797 - DNA, 13 bp, C. elegans
ttttagacgtttt

SEQ ID NO: 743798 - DNA, 13 bp, C. elegans
ttttagactcaaa

SEQ ID NO: 743799 - DNA, 13 bp, C. elegans
ttttagactgttt

SEQ ID NO: 743800 - DNA, 13 bp, C. elegans
ttttagacttttc

SEQ ID NO: 743801 - DNA, 13 bp, C. elegans
ttttagagaaaaa

SEQ ID NO: 743802 - DNA, 13 bp, C. elegans
ttttagagcaaaa

SEQ ID NO: 743803 - DNA, 13 bp, C. elegans
ttttagagctgaa

SEQ ID NO: 743804 - DNA, 13 bp, C. elegans
ttttagaggagtt

SEQ ID NO: 743805 - DNA, 13 bp, C. elegans
ttttagataaact

SEQ ID NO: 743806 - DNA, 13 bp, C. elegans
ttttagatcaaat

SEQ ID NO: 743807 - DNA, 13 bp, C. elegans
ttttagatgaaaa

SEQ ID NO: 743808 - DNA, 13 bp, C. elegans
ttttagatggaaa

SEQ ID NO: 743809 - DNA, 13 bp, C. elegans
ttttagatgtacc

SEQ ID NO: 743810 - DNA, 13 bp, C. elegans
ttttagattctaa

SEQ ID NO: 743811 - DNA, 13 bp, C. elegans
ttttagattcttg

SEQ ID NO: 743812 - DNA, 13 bp, C. elegans
ttttagatttcaa

SEQ ID NO: 743813 - DNA, 13 bp, C. elegans
ttttagattttac

SEQ ID NO: 743814 - DNA, 13 bp, C. elegans
ttttagattttcc

SEQ ID NO: 743815 - DNA, 13 bp, C. elegans
ttttagcacaatt

SEQ ID NO: 743816 - DNA, 13 bp, C. elegans
ttttagcagtttt

SEQ ID NO: 743817 - DNA, 13 bp, C. elegans
ttttagcataaaa

SEQ ID NO: 743818 - DNA, 13 bp, C. elegans
ttttagcataatt

SEQ ID NO: 743819 - DNA, 13 bp, C. elegans
ttttagcatattt

SEQ ID NO: 743820 - DNA, 13 bp, C. elegans
ttttagcatctaa

SEQ ID NO: 743821 - DNA, 13 bp, C. elegans
ttttagcatgttt

SEQ ID NO: 743822 - DNA, 13 bp, C. elegans
ttttagccaaaaa

SEQ ID NO: 743823 - DNA, 13 bp, C. elegans
ttttagctaaatt

SEQ ID NO: 743824 - DNA, 13 bp, C. elegans
ttttagctaatta

SEQ ID NO: 743825 - DNA, 13 bp, C. elegans
ttttagctgaaaa

SEQ ID NO: 743826 - DNA, 13 bp, C. elegans
ttttagctggaaa

SEQ ID NO: 743827 - DNA, 13 bp, C. elegans
ttttagcttaaaa

SEQ ID NO: 743828 - DNA, 13 bp, C. elegans
ttttagcttgaaa

SEQ ID NO: 743829 - DNA, 13 bp, C. elegans
ttttagctttaaa

SEQ ID NO: 743830 - DNA, 13 bp, C. elegans
ttttaggaaaaaa

SEQ ID NO: 743831 - DNA, 13 bp, C. elegans
ttttaggaaaaat

SEQ ID NO: 743832 - DNA, 13 bp, C. elegans
ttttaggaaaact

SEQ ID NO: 743833 - DNA, 13 bp, C. elegans
ttttaggaagaaa

SEQ ID NO: 743834 - DNA, 13 bp, C. elegans
ttttaggacattt

SEQ ID NO: 743835 - DNA, 13 bp, C. elegans
ttttaggagaaaa

SEQ ID NO: 743836 - DNA, 13 bp, C. elegans
ttttaggatcttt

SEQ ID NO: 743837 - DNA, 13 bp, C. elegans
ttttaggatttct

SEQ ID NO: 743838 - DNA, 13 bp, C. elegans
ttttaggcaaaaa

SEQ ID NO: 743839 - DNA, 13 bp, C. elegans
ttttaggcagttt

SEQ ID NO: 743840 - DNA, 13 bp, C. elegans
ttttaggccaaaa

SEQ ID NO: 743841 - DNA, 13 bp, C. elegans
ttttaggccagaa

SEQ ID NO: 743842 - DNA, 13 bp, C. elegans
ttttaggcctatt

SEQ ID NO: 743843 - DNA, 13 bp, C. elegans
ttttaggcttttc

SEQ ID NO: 743844 - DNA, 13 bp, C. elegans
ttttaggtcattt

SEQ ID NO: 743845 - DNA, 13 bp, C. elegans
ttttaggttgaaa

SEQ ID NO: 743846 - DNA, 13 bp, C. elegans
ttttaggtttaga

SEQ ID NO: 743847 - DNA, 13 bp, C. elegans
ttttaggtttgaa

SEQ ID NO: 743848 - DNA, 13 bp, C. elegans
ttttagtaatttc

SEQ ID NO: 743849 - DNA, 13 bp, C. elegans
ttttagtacaatt

SEQ ID NO: 743850 - DNA, 13 bp, C. elegans
ttttagtagaaaa

SEQ ID NO: 743851 - DNA, 13 bp, C. elegans
ttttagtcaaaat

SEQ ID NO: 743852 - DNA, 13 bp, C. elegans
ttttagtcaaagt

SEQ ID NO: 743853 - DNA, 13 bp, C. elegans
ttttagtcaattt

SEQ ID NO: 743854 - DNA, 13 bp, C. elegans
ttttagtcgaaaa

SEQ ID NO: 743855 - DNA, 13 bp, C. elegans
ttttagtgaaata

SEQ ID NO: 743856 - DNA, 13 bp, C. elegans
ttttagtgaacaa

SEQ ID NO: 743857 - DNA, 13 bp, C. elegans
ttttagtgagaaa

SEQ ID NO: 743858 - DNA, 13 bp, C. elegans
ttttagtgcaaaa

SEQ ID NO: 743859 - DNA, 13 bp, C. elegans
ttttagtgtaaat

SEQ ID NO: 743860 - DNA, 13 bp, C. elegans
ttttagttaggaa

SEQ ID NO: 743861 - DNA, 13 bp, C. elegans
ttttagttcgaaa

SEQ ID NO: 743862 - DNA, 13 bp, C. elegans
ttttagttgaaaa

SEQ ID NO: 743863 - DNA, 13 bp, C. elegans
ttttagtttcaga

SEQ ID NO: 743864 - DNA, 13 bp, C. elegans
ttttagtttcagt

SEQ ID NO: 743865 - DNA, 13 bp, C. elegans
ttttagtttctaa

SEQ ID NO: 743866 - DNA, 13 bp, C. elegans
ttttagtttctca

SEQ ID NO: 743867 - DNA, 13 bp, C. elegans
ttttagttttcgg

SEQ ID NO: 743868 - DNA, 13 bp, C. elegans
ttttataaaacca

SEQ ID NO: 743869 - DNA, 13 bp, C. elegans
ttttataaaacct

SEQ ID NO: 743870 - DNA, 13 bp, C. elegans
ttttataaaagct

SEQ ID NO: 743871 - DNA, 13 bp, C. elegans
ttttataaacatc

SEQ ID NO: 743872 - DNA, 13 bp, C. elegans
ttttataaactca

SEQ ID NO: 743873 - DNA, 13 bp, C. elegans
ttttataacaact

SEQ ID NO: 743874 - DNA, 13 bp, C. elegans
ttttataacgtga

SEQ ID NO: 743875 - DNA, 13 bp, C. elegans
ttttataacgttt

SEQ ID NO: 743876 - DNA, 13 bp, C. elegans
ttttataattgct

SEQ ID NO: 743877 - DNA, 13 bp, C. elegans
ttttataccaaaa

SEQ ID NO: 743878 - DNA, 13 bp, C. elegans
ttttataccaaat

SEQ ID NO: 743879 - DNA, 13 bp, C. elegans
ttttatacgattt

SEQ ID NO: 743880 - DNA, 13 bp, C. elegans
ttttatactcaaa

SEQ ID NO: 743881 - DNA, 13 bp, C. elegans
ttttatactgaaa

SEQ ID NO: 743882 - DNA, 13 bp, C. elegans
ttttatacttgaa

SEQ ID NO: 743883 - DNA, 13 bp, C. elegans
ttttatagacttt

SEQ ID NO: 743884 - DNA, 13 bp, C. elegans
ttttatagttcaa

SEQ ID NO: 743885 - DNA, 13 bp, C. elegans
ttttatatcagtt

SEQ ID NO: 743886 - DNA, 13 bp, C. elegans
ttttatatcgaaa

SEQ ID NO: 743887 - DNA, 13 bp, C. elegans
ttttatatgaaca

SEQ ID NO: 743888 - DNA, 13 bp, C. elegans
ttttatatgcatc

SEQ ID NO: 743889 - DNA, 13 bp, C. elegans
ttttatatgcatt

SEQ ID NO: 743890 - DNA, 13 bp, C. elegans
ttttatatggaaa

SEQ ID NO: 743891 - DNA, 13 bp, C. elegans
ttttatcaaactt

SEQ ID NO: 743892 - DNA, 13 bp, C. elegans
ttttatcaaagaa

SEQ ID NO: 743893 - DNA, 13 bp, C. elegans
ttttatcaaagat

SEQ ID NO: 743894 - DNA, 13 bp, C. elegans
ttttatcaacaat

SEQ ID NO: 743895 - DNA, 13 bp, C. elegans
ttttatcaagaaa

SEQ ID NO: 743896 - DNA, 13 bp, C. elegans
ttttatcaatgaa

SEQ ID NO: 743897 - DNA, 13 bp, C. elegans
ttttatcaattga

SEQ ID NO: 743898 - DNA, 13 bp, C. elegans
ttttatcacttca

SEQ ID NO: 743899 - DNA, 13 bp, C. elegans
ttttatcagaaaa

SEQ ID NO: 743900 - DNA, 13 bp, C. elegans
ttttatcagacaa

SEQ ID NO: 743901 - DNA, 13 bp, C. elegans
ttttatcagattt

SEQ ID NO: 743902 - DNA, 13 bp, C. elegans
ttttatcagttga

SEQ ID NO: 743903 - DNA, 13 bp, C. elegans
ttttatcatgaaa

SEQ ID NO: 743904 - DNA, 14 bp, C. elegans
ttttatcatgatat

SEQ ID NO: 743905 - DNA, 13 bp, C. elegans
ttttatcattgaa

SEQ ID NO: 743906 - DNA, 13 bp, C. elegans
ttttatccagttt

SEQ ID NO: 743907 - DNA, 13 bp, C. elegans
ttttatcccaaaa

SEQ ID NO: 743908 - DNA, 13 bp, C. elegans
ttttatccgaatt

SEQ ID NO: 743909 - DNA, 13 bp, C. elegans
ttttatcgaaaaa

SEQ ID NO: 743910 - DNA, 13 bp, C. elegans
ttttatcgaatta

SEQ ID NO: 743911 - DNA, 13 bp, C. elegans
ttttatcgaattc

SEQ ID NO: 743912 - DNA, 13 bp, C. elegans
ttttatcgaattt

SEQ ID NO: 743913 - DNA, 15 bp, C. elegans
ttttatcgaattttt

SEQ ID NO: 743914 - DNA, 13 bp, C. elegans
ttttatcggaatt

SEQ ID NO: 743915 - DNA, 13 bp, C. elegans
ttttatcggcaaa

SEQ ID NO: 743916 - DNA, 13 bp, C. elegans
ttttatcgttaaa

SEQ ID NO: 743917 - DNA, 13 bp, C. elegans
ttttatctcaaaa

SEQ ID NO: 743918 - DNA, 13 bp, C. elegans
ttttatctgaaac

SEQ ID NO: 743919 - DNA, 13 bp, C. elegans
ttttatctgcaaa

SEQ ID NO: 743920 - DNA, 13 bp, C. elegans
ttttatcttgaaa

SEQ ID NO: 743921 - DNA, 13 bp, C. elegans
ttttatcttgaat

SEQ ID NO: 743922 - DNA, 13 bp, C. elegans
ttttatctttgaa

SEQ ID NO: 743923 - DNA, 13 bp, C. elegans
ttttatgaaaaga

SEQ ID NO: 743924 - DNA, 13 bp, C. elegans
ttttatgaaagaa

SEQ ID NO: 743925 - DNA, 13 bp, C. elegans
ttttatgaacata

SEQ ID NO: 743926 - DNA, 13 bp, C. elegans
ttttatgaacatt

SEQ ID NO: 743927 - DNA, 13 bp, C. elegans
ttttatgaacttc

SEQ ID NO: 743928 - DNA, 13 bp, C. elegans
ttttatgaacttt

SEQ ID NO: 743929 - DNA, 13 bp, C. elegans
ttttatgacaaag

SEQ ID NO: 743930 - DNA, 13 bp, C. elegans
ttttatgatattc

SEQ ID NO: 743931 - DNA, 13 bp, C. elegans
ttttatgattcaa

SEQ ID NO: 743932 - DNA, 13 bp, C. elegans
ttttatgattgaa

SEQ ID NO: 743933 - DNA, 13 bp, C. elegans
ttttatgcaaaaa

SEQ ID NO: 743934 - DNA, 13 bp, C. elegans
ttttatgcaaatt

SEQ ID NO: 743935 - DNA, 13 bp, C. elegans
ttttatgcacatt

SEQ ID NO: 743936 - DNA, 13 bp, C. elegans
ttttatgctcaaa

SEQ ID NO: 743937 - DNA, 13 bp, C. elegans
ttttatgcttcat

SEQ ID NO: 743938 - DNA, 13 bp, C. elegans
ttttatgctttaa

SEQ ID NO: 743939 - DNA, 13 bp, C. elegans
ttttatggaaaaa

SEQ ID NO: 743940 - DNA, 13 bp, C. elegans
ttttatggaaagt

SEQ ID NO: 743941 - DNA, 13 bp, C. elegans
ttttatggaagaa

SEQ ID NO: 743942 - DNA, 13 bp, C. elegans
ttttatggcaaaa

SEQ ID NO: 743943 - DNA, 13 bp, C. elegans
ttttatggcattt

SEQ ID NO: 743944 - DNA, 13 bp, C. elegans
ttttatggcgatt

SEQ ID NO: 743945 - DNA, 13 bp, C. elegans
ttttatggcggtt

SEQ ID NO: 743946 - DNA, 13 bp, C. elegans
ttttatgggaaaa

SEQ ID NO: 743947 - DNA, 13 bp, C. elegans
ttttatgggtttc

SEQ ID NO: 743948 - DNA, 13 bp, C. elegans
ttttatgtactta

SEQ ID NO: 743949 - DNA, 13 bp, C. elegans
ttttatgtcgaaa

SEQ ID NO: 743950 - DNA, 13 bp, C. elegans
ttttatgtggaaa

SEQ ID NO: 743951 - DNA, 13 bp, C. elegans
ttttatgttcaaa

SEQ ID NO: 743952 - DNA, 13 bp, C. elegans
ttttatgtttaca

SEQ ID NO: 743953 - DNA, 13 bp, C. elegans
ttttatgtttcaa

SEQ ID NO: 743954 - DNA, 13 bp, C. elegans
ttttattacacat

SEQ ID NO: 743955 - DNA, 13 bp, C. elegans
ttttattaccata

SEQ ID NO: 743956 - DNA, 13 bp, C. elegans
ttttattacgata

SEQ ID NO: 743957 - DNA, 13 bp, C. elegans
ttttattacggaa

SEQ ID NO: 743958 - DNA, 13 bp, C. elegans
ttttattactgaa

SEQ ID NO: 743959 - DNA, 13 bp, C. elegans
ttttattatgaca

SEQ ID NO: 743960 - DNA, 13 bp, C. elegans
ttttattcaaaag

SEQ ID NO: 743961 - DNA, 13 bp, C. elegans
ttttattcagatt

SEQ ID NO: 743962 - DNA, 13 bp, C. elegans
ttttattcatcaa

SEQ ID NO: 743963 - DNA, 13 bp, C. elegans
ttttattccaaat

SEQ ID NO: 743964 - DNA, 13 bp, C. elegans
ttttattccacaa

SEQ ID NO: 743965 - DNA, 13 bp, C. elegans
ttttattccagtt

SEQ ID NO: 743966 - DNA, 13 bp, C. elegans
ttttattccgaaa

SEQ ID NO: 743967 - DNA, 13 bp, C. elegans
ttttattcctgaa

SEQ ID NO: 743968 - DNA, 13 bp, C. elegans
ttttattcgaaaa

SEQ ID NO: 743969 - DNA, 14 bp, C. elegans
ttttattcgaaaat

SEQ ID NO: 743970 - DNA, 13 bp, C. elegans
ttttattcgaatt

SEQ ID NO: 743971 - DNA, 13 bp, C. elegans
ttttattcgatta

SEQ ID NO: 743972 - DNA, 13 bp, C. elegans
ttttattcggaaa

SEQ ID NO: 743973 - DNA, 13 bp, C. elegans
ttttattcggatt

SEQ ID NO: 743974 - DNA, 13 bp, C. elegans
ttttattcggcaa

SEQ ID NO: 743975 - DNA, 13 bp, C. elegans
ttttattctcaaa

SEQ ID NO: 743976 - DNA, 13 bp, C. elegans
ttttattctgaaa

SEQ ID NO: 743977 - DNA, 13 bp, C. elegans
ttttattgaaacc

SEQ ID NO: 743978 - DNA, 13 bp, C. elegans
ttttattgaaagt

SEQ ID NO: 743979 - DNA, 13 bp, C. elegans
ttttattgaagaa

SEQ ID NO: 743980 - DNA, 13 bp, C. elegans
ttttattgacagt

SEQ ID NO: 743981 - DNA, 13 bp, C. elegans
ttttattgagaaa

SEQ ID NO: 743982 - DNA, 13 bp, C. elegans
ttttattgatatc

SEQ ID NO: 743983 - DNA, 13 bp, C. elegans
ttttattgattca

SEQ ID NO: 743984 - DNA, 13 bp, C. elegans
ttttattgcaaaa

SEQ ID NO: 743985 - DNA, 13 bp, C. elegans
ttttattgcaatg

SEQ ID NO: 743986 - DNA, 13 bp, C. elegans
ttttattgcacaa

SEQ ID NO: 743987 - DNA, 13 bp, C. elegans
ttttattgcacat

SEQ ID NO: 743988 - DNA, 13 bp, C. elegans
ttttattgctcca

SEQ ID NO: 743989 - DNA, 13 bp, C. elegans
ttttattggaaca

SEQ ID NO: 743990 - DNA, 13 bp, C. elegans
ttttattgggaaa

SEQ ID NO: 743991 - DNA, 13 bp, C. elegans
ttttattgttaca

SEQ ID NO: 743992 - DNA, 13 bp, C. elegans
ttttattgttcag

SEQ ID NO: 743993 - DNA, 13 bp, C. elegans
ttttattgttgca

SEQ ID NO: 743994 - DNA, 13 bp, C. elegans
ttttatttcaaac

SEQ ID NO: 743995 - DNA, 13 bp, C. elegans
ttttatttcaatg

SEQ ID NO: 743996 - DNA, 13 bp, C. elegans
ttttatttcagaa

SEQ ID NO: 743997 - DNA, 13 bp, C. elegans
ttttatttcagat

SEQ ID NO: 743998 - DNA, 13 bp, C. elegans
ttttatttcagca

SEQ ID NO: 743999 - DNA, 13 bp, C. elegans
ttttatttctaga

SEQ ID NO: 744000 - DNA, 13 bp, C. elegans
ttttatttctgaa

SEQ ID NO: 744001 - DNA, 13 bp, C. elegans
ttttatttgaaac

SEQ ID NO: 744002 - DNA, 13 bp, C. elegans
ttttatttgaatc

SEQ ID NO: 744003 - DNA, 13 bp, C. elegans
ttttatttggaag

SEQ ID NO: 744004 - DNA, 13 bp, C. elegans
ttttattttcaag

SEQ ID NO: 744005 - DNA, 13 bp, C. elegans
ttttattttcccg

SEQ ID NO: 744006 - DNA, 13 bp, C. elegans
ttttattttggca

SEQ ID NO: 744007 - DNA, 13 bp, C. elegans
ttttcaaaaaaag

SEQ ID NO: 744008 - DNA, 13 bp, C. elegans
ttttcaaaaaacg

SEQ ID NO: 744009 - DNA, 13 bp, C. elegans
ttttcaaaaaaga

SEQ ID NO: 744010 - DNA, 13 bp, C. elegans
ttttcaaaaaatc

SEQ ID NO: 744011 - DNA, 13 bp, C. elegans
ttttcaaaaaatg

SEQ ID NO: 744012 - DNA, 13 bp, C. elegans
ttttcaaaaacaa

SEQ ID NO: 744013 - DNA, 13 bp, C. elegans
ttttcaaaaacat

SEQ ID NO: 744014 - DNA, 13 bp, C. elegans
ttttcaaaaacta

SEQ ID NO: 744015 - DNA, 13 bp, C. elegans
ttttcaaaaagct

SEQ ID NO: 744016 - DNA, 13 bp, C. elegans
ttttcaaaaagtg

SEQ ID NO: 744017 - DNA, 13 bp, C. elegans
ttttcaaaaagtt

SEQ ID NO: 744018 - DNA, 13 bp, C. elegans
ttttcaaaaatct

SEQ ID NO: 744019 - DNA, 14 bp, C. elegans
ttttcaaaaattgt

SEQ ID NO: 744020 - DNA, 13 bp, C. elegans
ttttcaaaaccgg

SEQ ID NO: 744021 - DNA, 13 bp, C. elegans
ttttcaaaacgcc

SEQ ID NO: 744022 - DNA, 13 bp, C. elegans
ttttcaaaactcc

SEQ ID NO: 744023 - DNA, 13 bp, C. elegans
ttttcaaaacttt

SEQ ID NO: 744024 - DNA, 13 bp, C. elegans
ttttcaaaagaaa

SEQ ID NO: 744025 - DNA, 13 bp, C. elegans
ttttcaaaagcat

SEQ ID NO: 744026 - DNA, 13 bp, C. elegans
ttttcaaaagctt

SEQ ID NO: 744027 - DNA, 13 bp, C. elegans
ttttcaaaagttt

SEQ ID NO: 744028 - DNA, 13 bp, C. elegans
ttttcaaaataga

SEQ ID NO: 744029 - DNA, 13 bp, C. elegans
ttttcaaaatagt

SEQ ID NO: 744030 - DNA, 13 bp, C. elegans
ttttcaaaatcat

SEQ ID NO: 744031 - DNA, 13 bp, C. elegans
ttttcaaaatctt

SEQ ID NO: 744032 - DNA, 13 bp, C. elegans
ttttcaaaatgaa

SEQ ID NO: 744033 - DNA, 13 bp, C. elegans
ttttcaaaatgtc

SEQ ID NO: 744034 - DNA, 13 bp, C. elegans
ttttcaaaatgtt

SEQ ID NO: 744035 - DNA, 13 bp, C. elegans
ttttcaaaattct

SEQ ID NO: 744036 - DNA, 13 bp, C. elegans
ttttcaaaattga

SEQ ID NO: 744037 - DNA, 13 bp, C. elegans
ttttcaaacaaaa

SEQ ID NO: 744038 - DNA, 13 bp, C. elegans
ttttcaaacactt

SEQ ID NO: 744039 - DNA, 13 bp, C. elegans
ttttcaaacataa

SEQ ID NO: 744040 - DNA, 13 bp, C. elegans
ttttcaaacatta

SEQ ID NO: 744041 - DNA, 13 bp, C. elegans
ttttcaaacattc

SEQ ID NO: 744042 - DNA, 13 bp, C. elegans
ttttcaaacgttc

SEQ ID NO: 744043 - DNA, 13 bp, C. elegans
ttttcaaactaaa

SEQ ID NO: 744044 - DNA, 13 bp, C. elegans
ttttcaaactaca

SEQ ID NO: 744045 - DNA, 13 bp, C. elegans
ttttcaaactata

SEQ ID NO: 744046 - DNA, 13 bp, C. elegans
ttttcaaactatt

SEQ ID NO: 744047 - DNA, 13 bp, C. elegans
ttttcaaactgaa

SEQ ID NO: 744048 - DNA, 13 bp, C. elegans
ttttcaaactgtt

SEQ ID NO: 744049 - DNA, 13 bp, C. elegans
ttttcaaacttac

SEQ ID NO: 744050 - DNA, 13 bp, C. elegans
ttttcaaacttca

SEQ ID NO: 744051 - DNA, 13 bp, C. elegans
ttttcaaacttta

SEQ ID NO: 744052 - DNA, 13 bp, C. elegans
ttttcaaactttc

SEQ ID NO: 744053 - DNA, 13 bp, C. elegans
ttttcaaagaaaa

SEQ ID NO: 744054 - DNA, 13 bp, C. elegans
ttttcaaagaact

SEQ ID NO: 744055 - DNA, 13 bp, C. elegans
ttttcaaagaatt

SEQ ID NO: 744056 - DNA, 13 bp, C. elegans
ttttcaaagatga

SEQ ID NO: 744057 - DNA, 13 bp, C. elegans
ttttcaaagcgaa

SEQ ID NO: 744058 - DNA, 13 bp, C. elegans
ttttcaaagctca

SEQ ID NO: 744059 - DNA, 13 bp, C. elegans
ttttcaaagtata

SEQ ID NO: 744060 - DNA, 13 bp, C. elegans
ttttcaaagtgtt

SEQ ID NO: 744061 - DNA, 13 bp, C. elegans
ttttcaaagttca

SEQ ID NO: 744062 - DNA, 13 bp, C. elegans
ttttcaaagtttc

SEQ ID NO: 744063 - DNA, 13 bp, C. elegans
ttttcaaagtttt

SEQ ID NO: 744064 - DNA, 13 bp, C. elegans
ttttcaaatacat

SEQ ID NO: 744065 - DNA, 13 bp, C. elegans
ttttcaaatacca

SEQ ID NO: 744066 - DNA, 13 bp, C. elegans
ttttcaaatagtt

SEQ ID NO: 744067 - DNA, 13 bp, C. elegans
ttttcaaatattc

SEQ ID NO: 744068 - DNA, 13 bp, C. elegans
ttttcaaatcaat

SEQ ID NO: 744069 - DNA, 13 bp, C. elegans
ttttcaaatccaa

SEQ ID NO: 744070 - DNA, 13 bp, C. elegans
ttttcaaatctct

SEQ ID NO: 744071 - DNA, 13 bp, C. elegans
ttttcaaatgaaa

SEQ ID NO: 744072 - DNA, 13 bp, C. elegans
ttttcaaatgaac

SEQ ID NO: 744073 - DNA, 13 bp, C. elegans
ttttcaaatgata

SEQ ID NO: 744074 - DNA, 13 bp, C. elegans
ttttcaaatgatg

SEQ ID NO: 744075 - DNA, 13 bp, C. elegans
ttttcaaatgcaa

SEQ ID NO: 744076 - DNA, 13 bp, C. elegans
ttttcaaatggaa

SEQ ID NO: 744077 - DNA, 13 bp, C. elegans
ttttcaaatgttt

SEQ ID NO: 744078 - DNA, 13 bp, C. elegans
ttttcaaattaac

SEQ ID NO: 744079 - DNA, 13 bp, C. elegans
ttttcaaattaca

SEQ ID NO: 744080 - DNA, 13 bp, C. elegans
ttttcaaattcca

SEQ ID NO: 744081 - DNA, 13 bp, C. elegans
ttttcaaattcta

SEQ ID NO: 744082 - DNA, 13 bp, C. elegans
ttttcaaattctg

SEQ ID NO: 744083 - DNA, 13 bp, C. elegans
ttttcaaatttca

SEQ ID NO: 744084 - DNA, 13 bp, C. elegans
ttttcaaatttgt

SEQ ID NO: 744085 - DNA, 15 bp, C. elegans
ttttcaaattttgtt

SEQ ID NO: 744086 - DNA, 13 bp, C. elegans
ttttcaacaaaac

SEQ ID NO: 744087 - DNA, 13 bp, C. elegans
ttttcaacaaatt

SEQ ID NO: 744088 - DNA, 13 bp, C. elegans
ttttcaacaacaa

SEQ ID NO: 744089 - DNA, 13 bp, C. elegans
ttttcaacaactt

SEQ ID NO: 744090 - DNA, 13 bp, C. elegans
ttttcaacaataa

SEQ ID NO: 744091 - DNA, 13 bp, C. elegans
ttttcaacaatat

SEQ ID NO: 744092 - DNA, 13 bp, C. elegans
ttttcaacaatta

SEQ ID NO: 744093 - DNA, 13 bp, C. elegans
ttttcaacaattt

SEQ ID NO: 744094 - DNA, 13 bp, C. elegans
ttttcaacacttt

SEQ ID NO: 744095 - DNA, 13 bp, C. elegans
ttttcaacagatt

SEQ ID NO: 744096 - DNA, 13 bp, C. elegans
ttttcaacatcat

SEQ ID NO: 744097 - DNA, 13 bp, C. elegans
ttttcaacattaa

SEQ ID NO: 744098 - DNA, 13 bp, C. elegans
ttttcaacattct

SEQ ID NO: 744099 - DNA, 13 bp, C. elegans
ttttcaacattga

SEQ ID NO: 744100 - DNA, 13 bp, C. elegans
ttttcaacattta

SEQ ID NO: 744101 - DNA, 13 bp, C. elegans
ttttcaacatttg

SEQ ID NO: 744102 - DNA, 13 bp, C. elegans
ttttcaaccaaaa

SEQ ID NO: 744103 - DNA, 13 bp, C. elegans
ttttcaaccaatt

SEQ ID NO: 744104 - DNA, 13 bp, C. elegans
ttttcaacctcaa

SEQ ID NO: 744105 - DNA, 13 bp, C. elegans
ttttcaacctgaa

SEQ ID NO: 744106 - DNA, 13 bp, C. elegans
ttttcaacgaaaa

SEQ ID NO: 744107 - DNA, 13 bp, C. elegans
ttttcaacgaaat

SEQ ID NO: 744108 - DNA, 13 bp, C. elegans
ttttcaacgaatt

SEQ ID NO: 744109 - DNA, 13 bp, C. elegans
ttttcaacgagaa

SEQ ID NO: 744110 - DNA, 13 bp, C. elegans
ttttcaacgattt

SEQ ID NO: 744111 - DNA, 13 bp, C. elegans
ttttcaacgtttg

SEQ ID NO: 744112 - DNA, 13 bp, C. elegans
ttttcaacgtttt

SEQ ID NO: 744113 - DNA, 13 bp, C. elegans
ttttcaactagat

SEQ ID NO: 744114 - DNA, 13 bp, C. elegans
ttttcaactcatt

SEQ ID NO: 744115 - DNA, 13 bp, C. elegans
ttttcaactgttt

SEQ ID NO: 744116 - DNA, 13 bp, C. elegans
ttttcaacttcac

SEQ ID NO: 744117 - DNA, 13 bp, C. elegans
ttttcaacttcat

SEQ ID NO: 744118 - DNA, 13 bp, C. elegans
ttttcaacttcta

SEQ ID NO: 744119 - DNA, 13 bp, C. elegans
ttttcaactttac

SEQ ID NO: 744120 - DNA, 13 bp, C. elegans
ttttcaactttca

SEQ ID NO: 744121 - DNA, 13 bp, C. elegans
ttttcaactttcc

SEQ ID NO: 744122 - DNA, 13 bp, C. elegans
ttttcaactttga

SEQ ID NO: 744123 - DNA, 13 bp, C. elegans
ttttcaagaaaaa

SEQ ID NO: 744124 - DNA, 13 bp, C. elegans
ttttcaagaaaat

SEQ ID NO: 744125 - DNA, 13 bp, C. elegans
ttttcaagaagtt

SEQ ID NO: 744126 - DNA, 13 bp, C. elegans
ttttcaagaattt

SEQ ID NO: 744127 - DNA, 13 bp, C. elegans
ttttcaagagaaa

SEQ ID NO: 744128 - DNA, 13 bp, C. elegans
ttttcaagagaat

SEQ ID NO: 744129 - DNA, 13 bp, C. elegans
ttttcaagatgaa

SEQ ID NO: 744130 - DNA, 13 bp, C. elegans
ttttcaagatttt

SEQ ID NO: 744131 - DNA, 13 bp, C. elegans
ttttcaagcagtt

SEQ ID NO: 744132 - DNA, 13 bp, C. elegans
ttttcaagccatt

SEQ ID NO: 744133 - DNA, 13 bp, C. elegans
ttttcaagctaaa

SEQ ID NO: 744134 - DNA, 13 bp, C. elegans
ttttcaagctaac

SEQ ID NO: 744135 - DNA, 13 bp, C. elegans
ttttcaagcttct

SEQ ID NO: 744136 - DNA, 13 bp, C. elegans
ttttcaaggaaaa

SEQ ID NO: 744137 - DNA, 13 bp, C. elegans
ttttcaaggatca

SEQ ID NO: 744138 - DNA, 13 bp, C. elegans
ttttcaaggtttt

SEQ ID NO: 744139 - DNA, 13 bp, C. elegans
ttttcaagtaaaa

SEQ ID NO: 744140 - DNA, 13 bp, C. elegans
ttttcaagtagaa

SEQ ID NO: 744141 - DNA, 13 bp, C. elegans
ttttcaagtattt

SEQ ID NO: 744142 - DNA, 13 bp, C. elegans
ttttcaagtcata

SEQ ID NO: 744143 - DNA, 13 bp, C. elegans
ttttcaagtgaca

SEQ ID NO: 744144 - DNA, 13 bp, C. elegans
ttttcaagtggaa

SEQ ID NO: 744145 - DNA, 13 bp, C. elegans
ttttcaagtgttt

SEQ ID NO: 744146 - DNA, 13 bp, C. elegans
ttttcaagttaga

SEQ ID NO: 744147 - DNA, 13 bp, C. elegans
ttttcaagttcat

SEQ ID NO: 744148 - DNA, 13 bp, C. elegans
ttttcaagttgaa

SEQ ID NO: 744149 - DNA, 13 bp, C. elegans
ttttcaagttgag

SEQ ID NO: 744150 - DNA, 13 bp, C. elegans
ttttcaagtttaa

SEQ ID NO: 744151 - DNA, 13 bp, C. elegans
ttttcaagtttat

SEQ ID NO: 744152 - DNA, 13 bp, C. elegans
ttttcaagtttct

SEQ ID NO: 744153 - DNA, 13 bp, C. elegans
ttttcaagtttgt

SEQ ID NO: 744154 - DNA, 13 bp, C. elegans
ttttcaagtttta

SEQ ID NO: 744155 - DNA, 14 bp, C. elegans
ttttcaagttttca

SEQ ID NO: 744156 - DNA, 13 bp, C. elegans
ttttcaataaaac

SEQ ID NO: 744157 - DNA, 13 bp, C. elegans
ttttcaataaaga

SEQ ID NO: 744158 - DNA, 13 bp, C. elegans
ttttcaataaatg

SEQ ID NO: 744159 - DNA, 13 bp, C. elegans
ttttcaataactt

SEQ ID NO: 744160 - DNA, 13 bp, C. elegans
ttttcaataccgg

SEQ ID NO: 744161 - DNA, 13 bp, C. elegans
ttttcaatactat

SEQ ID NO: 744162 - DNA, 13 bp, C. elegans
ttttcaatacttc

SEQ ID NO: 744163 - DNA, 13 bp, C. elegans
ttttcaatagttg

SEQ ID NO: 744164 - DNA, 13 bp, C. elegans
ttttcaatatcca

SEQ ID NO: 744165 - DNA, 13 bp, C. elegans
ttttcaatattgt

SEQ ID NO: 744166 - DNA, 13 bp, C. elegans
ttttcaatcaaaa

SEQ ID NO: 744167 - DNA, 14 bp, C. elegans
ttttcaatcaaatt

SEQ ID NO: 744168 - DNA, 13 bp, C. elegans
ttttcaatcaatt

SEQ ID NO: 744169 - DNA, 13 bp, C. elegans
ttttcaatcataa

SEQ ID NO: 744170 - DNA, 13 bp, C. elegans
ttttcaatcatta

SEQ ID NO: 744171 - DNA, 13 bp, C. elegans
ttttcaatcattc

SEQ ID NO: 744172 - DNA, 13 bp, C. elegans
ttttcaatcgaaa

SEQ ID NO: 744173 - DNA, 13 bp, C. elegans
ttttcaatcgttt

SEQ ID NO: 744174 - DNA, 13 bp, C. elegans
ttttcaatctaaa

SEQ ID NO: 744175 - DNA, 13 bp, C. elegans
ttttcaatctcaa

SEQ ID NO: 744176 - DNA, 13 bp, C. elegans
ttttcaatcttcc

SEQ ID NO: 744177 - DNA, 13 bp, C. elegans
ttttcaatgaaaa

SEQ ID NO: 744178 - DNA, 13 bp, C. elegans
ttttcaatgaaat

SEQ ID NO: 744179 - DNA, 13 bp, C. elegans
ttttcaatgaatg

SEQ ID NO: 744180 - DNA, 13 bp, C. elegans
ttttcaatgaccg

SEQ ID NO: 744181 - DNA, 13 bp, C. elegans
ttttcaatgactt

SEQ ID NO: 744182 - DNA, 13 bp, C. elegans
ttttcaatgagtt

SEQ ID NO: 744183 - DNA, 13 bp, C. elegans
ttttcaatgatgt

SEQ ID NO: 744184 - DNA, 13 bp, C. elegans
ttttcaatgattc

SEQ ID NO: 744185 - DNA, 13 bp, C. elegans
ttttcaatgattt

SEQ ID NO: 744186 - DNA, 13 bp, C. elegans
ttttcaatggaaa

SEQ ID NO: 744187 - DNA, 13 bp, C. elegans
ttttcaatggatt

SEQ ID NO: 744188 - DNA, 13 bp, C. elegans
ttttcaatggctt

SEQ ID NO: 744189 - DNA, 13 bp, C. elegans
ttttcaatgggaa

SEQ ID NO: 744190 - DNA, 13 bp, C. elegans
ttttcaatggttt

SEQ ID NO: 744191 - DNA, 13 bp, C. elegans
ttttcaatgtctt

SEQ ID NO: 744192 - DNA, 13 bp, C. elegans
ttttcaatgttca

SEQ ID NO: 744193 - DNA, 13 bp, C. elegans
ttttcaatgtttc

SEQ ID NO: 744194 - DNA, 13 bp, C. elegans
ttttcaattacaa

SEQ ID NO: 744195 - DNA, 13 bp, C. elegans
ttttcaattcaaa

SEQ ID NO: 744196 - DNA, 13 bp, C. elegans
ttttcaattcagt

SEQ ID NO: 744197 - DNA, 13 bp, C. elegans
ttttcaattccag

SEQ ID NO: 744198 - DNA, 13 bp, C. elegans
ttttcaattccca

SEQ ID NO: 744199 - DNA, 13 bp, C. elegans
ttttcaattcgtt

SEQ ID NO: 744200 - DNA, 13 bp, C. elegans
ttttcaattctca

SEQ ID NO: 744201 - DNA, 13 bp, C. elegans
ttttcaattgaaa

SEQ ID NO: 744202 - DNA, 13 bp, C. elegans
ttttcaattggtc

SEQ ID NO: 744203 - DNA, 13 bp, C. elegans
ttttcaatttcaa

SEQ ID NO: 744204 - DNA, 14 bp, C. elegans
ttttcaatttccaa

SEQ ID NO: 744205 - DNA, 13 bp, C. elegans
ttttcaatttccc

SEQ ID NO: 744206 - DNA, 13 bp, C. elegans
ttttcaatttgat

SEQ ID NO: 744207 - DNA, 13 bp, C. elegans
ttttcaatttgca

SEQ ID NO: 744208 - DNA, 13 bp, C. elegans
ttttcaattttag

SEQ ID NO: 744209 - DNA, 13 bp, C. elegans
ttttcaattttcg

SEQ ID NO: 744210 - DNA, 13 bp, C. elegans
ttttcaattttga

SEQ ID NO: 744211 - DNA, 13 bp, C. elegans
ttttcaattttgg

SEQ ID NO: 744212 - DNA, 13 bp, C. elegans
ttttcacaaaaaa

SEQ ID NO: 744213 - DNA, 13 bp, C. elegans
ttttcacaaaaat

SEQ ID NO: 744214 - DNA, 13 bp, C. elegans
ttttcacaaaatc

SEQ ID NO: 744215 - DNA, 13 bp, C. elegans
ttttcacaaacaa

SEQ ID NO: 744216 - DNA, 13 bp, C. elegans
ttttcacaaatat

SEQ ID NO: 744217 - DNA, 13 bp, C. elegans
ttttcacaaatta

SEQ ID NO: 744218 - DNA, 13 bp, C. elegans
ttttcacaaattg

SEQ ID NO: 744219 - DNA, 13 bp, C. elegans
ttttcacaaattt

SEQ ID NO: 744220 - DNA, 13 bp, C. elegans
ttttcacaacttt

SEQ ID NO: 744221 - DNA, 13 bp, C. elegans
ttttcacaataaa

SEQ ID NO: 744222 - DNA, 13 bp, C. elegans
ttttcacaatatt

SEQ ID NO: 744223 - DNA, 13 bp, C. elegans
ttttcacaattta

SEQ ID NO: 744224 - DNA, 13 bp, C. elegans
ttttcacacattt

SEQ ID NO: 744225 - DNA, 13 bp, C. elegans
ttttcacacgaaa

SEQ ID NO: 744226 - DNA, 13 bp, C. elegans
ttttcacacgttt

SEQ ID NO: 744227 - DNA, 13 bp, C. elegans
ttttcacactctt

SEQ ID NO: 744228 - DNA, 13 bp, C. elegans
ttttcacagaaat

SEQ ID NO: 744229 - DNA, 13 bp, C. elegans
ttttcacagaatt

SEQ ID NO: 744230 - DNA, 13 bp, C. elegans
ttttcacagcttt

SEQ ID NO: 744231 - DNA, 13 bp, C. elegans
ttttcacagttat

SEQ ID NO: 744232 - DNA, 13 bp, C. elegans
ttttcacagttga

SEQ ID NO: 744233 - DNA, 13 bp, C. elegans
ttttcacagtttt

SEQ ID NO: 744234 - DNA, 13 bp, C. elegans
ttttcacataaaa

SEQ ID NO: 744235 - DNA, 13 bp, C. elegans
ttttcacatattc

SEQ ID NO: 744236 - DNA, 13 bp, C. elegans
ttttcacatcaaa

SEQ ID NO: 744237 - DNA, 13 bp, C. elegans
ttttcacattcat

SEQ ID NO: 744238 - DNA, 13 bp, C. elegans
ttttcacattccc

SEQ ID NO: 744239 - DNA, 13 bp, C. elegans
ttttcacattgaa

SEQ ID NO: 744240 - DNA, 13 bp, C. elegans
ttttcacatttga

SEQ ID NO: 744241 - DNA, 13 bp, C. elegans
ttttcacatttgt

SEQ ID NO: 744242 - DNA, 13 bp, C. elegans
ttttcaccaaaaa

SEQ ID NO: 744243 - DNA, 13 bp, C. elegans
ttttcaccaactt

SEQ ID NO: 744244 - DNA, 13 bp, C. elegans
ttttcaccaagaa

SEQ ID NO: 744245 - DNA, 13 bp, C. elegans
ttttcaccaattc

SEQ ID NO: 744246 - DNA, 13 bp, C. elegans
ttttcaccagaaa

SEQ ID NO: 744247 - DNA, 13 bp, C. elegans
ttttcacccaaaa

SEQ ID NO: 744248 - DNA, 13 bp, C. elegans
ttttcacccaatt

SEQ ID NO: 744249 - DNA, 13 bp, C. elegans
ttttcaccgaaaa

SEQ ID NO: 744250 - DNA, 13 bp, C. elegans
ttttcaccgattt

SEQ ID NO: 744251 - DNA, 13 bp, C. elegans
ttttcaccggaaa

SEQ ID NO: 744252 - DNA, 13 bp, C. elegans
ttttcaccgtttc

SEQ ID NO: 744253 - DNA, 13 bp, C. elegans
ttttcaccgtttt

SEQ ID NO: 744254 - DNA, 14 bp, C. elegans
ttttcacctaatta

SEQ ID NO: 744255 - DNA, 13 bp, C. elegans
ttttcacctgttc

SEQ ID NO: 744256 - DNA, 13 bp, C. elegans
ttttcacctgttt

SEQ ID NO: 744257 - DNA, 13 bp, C. elegans
ttttcacgaaaaa

SEQ ID NO: 744258 - DNA, 13 bp, C. elegans
ttttcacgaaaat

SEQ ID NO: 744259 - DNA, 13 bp, C. elegans
ttttcacgaaatt

SEQ ID NO: 744260 - DNA, 13 bp, C. elegans
ttttcacggaaaa

SEQ ID NO: 744261 - DNA, 13 bp, C. elegans
ttttcacggaaat

SEQ ID NO: 744262 - DNA, 13 bp, C. elegans
ttttcacgttcaa

SEQ ID NO: 744263 - DNA, 13 bp, C. elegans
ttttcacgttttc

SEQ ID NO: 744264 - DNA, 13 bp, C. elegans
ttttcactaaaac

SEQ ID NO: 744265 - DNA, 13 bp, C. elegans
ttttcactaaatc

SEQ ID NO: 744266 - DNA, 13 bp, C. elegans
ttttcactcgaaa

SEQ ID NO: 744267 - DNA, 13 bp, C. elegans
ttttcactctaaa

SEQ ID NO: 744268 - DNA, 13 bp, C. elegans
ttttcactgaaaa

SEQ ID NO: 744269 - DNA, 13 bp, C. elegans
ttttcactgattt

SEQ ID NO: 744270 - DNA, 13 bp, C. elegans
ttttcacttttga

SEQ ID NO: 744271 - DNA, 14 bp, C. elegans
ttttcagaaaaatt

SEQ ID NO: 744272 - DNA, 13 bp, C. elegans
ttttcagaaaacc

SEQ ID NO: 744273 - DNA, 13 bp, C. elegans
ttttcagaaaact

SEQ ID NO: 744274 - DNA, 13 bp, C. elegans
ttttcagaaaatt

SEQ ID NO: 744275 - DNA, 13 bp, C. elegans
ttttcagaaagaa

SEQ ID NO: 744276 - DNA, 13 bp, C. elegans
ttttcagaaagtt

SEQ ID NO: 744277 - DNA, 13 bp, C. elegans
ttttcagaaatat

SEQ ID NO: 744278 - DNA, 13 bp, C. elegans
ttttcagaaatca

SEQ ID NO: 744279 - DNA, 13 bp, C. elegans
ttttcagaaattt

SEQ ID NO: 744280 - DNA, 13 bp, C. elegans
ttttcagaacaaa

SEQ ID NO: 744281 - DNA, 13 bp, C. elegans
ttttcagaactct

SEQ ID NO: 744282 - DNA, 13 bp, C. elegans
ttttcagaagaga

SEQ ID NO: 744283 - DNA, 13 bp, C. elegans
ttttcagaataaa

SEQ ID NO: 744284 - DNA, 13 bp, C. elegans
ttttcagaatatt

SEQ ID NO: 744285 - DNA, 13 bp, C. elegans
ttttcagaatctc

SEQ ID NO: 744286 - DNA, 13 bp, C. elegans
ttttcagaattca

SEQ ID NO: 744287 - DNA, 13 bp, C. elegans
ttttcagaatttc

SEQ ID NO: 744288 - DNA, 13 bp, C. elegans
ttttcagaatttt

SEQ ID NO: 744289 - DNA, 13 bp, C. elegans
ttttcagacaatc

SEQ ID NO: 744290 - DNA, 13 bp, C. elegans
ttttcagacgatt

SEQ ID NO: 744291 - DNA, 13 bp, C. elegans
ttttcagacgttt

SEQ ID NO: 744292 - DNA, 13 bp, C. elegans
ttttcagactaaa

SEQ ID NO: 744293 - DNA, 13 bp, C. elegans
ttttcagactttt

SEQ ID NO: 744294 - DNA, 13 bp, C. elegans
ttttcagagaaaa

SEQ ID NO: 744295 - DNA, 13 bp, C. elegans
ttttcagagaatt

SEQ ID NO: 744296 - DNA, 13 bp, C. elegans
ttttcagagattt

SEQ ID NO: 744297 - DNA, 13 bp, C. elegans
ttttcagagcttc

SEQ ID NO: 744298 - DNA, 13 bp, C. elegans
ttttcagagtatt

SEQ ID NO: 744299 - DNA, 13 bp, C. elegans
ttttcagagtgtt

SEQ ID NO: 744300 - DNA, 13 bp, C. elegans
ttttcagataaaa

SEQ ID NO: 744301 - DNA, 13 bp, C. elegans
ttttcagataaat

SEQ ID NO: 744302 - DNA, 13 bp, C. elegans
ttttcagataatt

SEQ ID NO: 744303 - DNA, 13 bp, C. elegans
ttttcagatagat

SEQ ID NO: 744304 - DNA, 13 bp, C. elegans
ttttcagatattc

SEQ ID NO: 744305 - DNA, 13 bp, C. elegans
ttttcagatattt

SEQ ID NO: 744306 - DNA, 13 bp, C. elegans
ttttcagatcaat

SEQ ID NO: 744307 - DNA, 13 bp, C. elegans
ttttcagatgaaa

SEQ ID NO: 744308 - DNA, 13 bp, C. elegans
ttttcagatgatt

SEQ ID NO: 744309 - DNA, 13 bp, C. elegans
ttttcagattata

SEQ ID NO: 744310 - DNA, 13 bp, C. elegans
ttttcagattctc

SEQ ID NO: 744311 - DNA, 13 bp, C. elegans
ttttcagattgtt

SEQ ID NO: 744312 - DNA, 14 bp, C. elegans
ttttcagatttctc

SEQ ID NO: 744313 - DNA, 13 bp, C. elegans
ttttcagcaaaaa

SEQ ID NO: 744314 - DNA, 13 bp, C. elegans
ttttcagcaattt

SEQ ID NO: 744315 - DNA, 13 bp, C. elegans
ttttcagcacttt

SEQ ID NO: 744316 - DNA, 13 bp, C. elegans
ttttcagcagttt

SEQ ID NO: 744317 - DNA, 13 bp, C. elegans
ttttcagcatatt

SEQ ID NO: 744318 - DNA, 14 bp, C. elegans
ttttcagcattttt

SEQ ID NO: 744319 - DNA, 13 bp, C. elegans
ttttcagccaaaa

SEQ ID NO: 744320 - DNA, 13 bp, C. elegans
ttttcagccaatt

SEQ ID NO: 744321 - DNA, 13 bp, C. elegans
ttttcagcgaaaa

SEQ ID NO: 744322 - DNA, 13 bp, C. elegans
ttttcagcgtttt

SEQ ID NO: 744323 - DNA, 13 bp, C. elegans
ttttcagctaaaa

SEQ ID NO: 744324 - DNA, 13 bp, C. elegans
ttttcagctaaat

SEQ ID NO: 744325 - DNA, 13 bp, C. elegans
ttttcagctataa

SEQ ID NO: 744326 - DNA, 14 bp, C. elegans
ttttcagctccaga

SEQ ID NO: 744327 - DNA, 13 bp, C. elegans
ttttcagcttctt

SEQ ID NO: 744328 - DNA, 13 bp, C. elegans
ttttcagctttca

SEQ ID NO: 744329 - DNA, 13 bp, C. elegans
ttttcagctttta

SEQ ID NO: 744330 - DNA, 13 bp, C. elegans
ttttcaggaaaaa

SEQ ID NO: 744331 - DNA, 13 bp, C. elegans
ttttcaggaaatt

SEQ ID NO: 744332 - DNA, 13 bp, C. elegans
ttttcaggatttt

SEQ ID NO: 744333 - DNA, 13 bp, C. elegans
ttttcaggcaaaa

SEQ ID NO: 744334 - DNA, 13 bp, C. elegans
ttttcaggccaaa

SEQ ID NO: 744335 - DNA, 13 bp, C. elegans
ttttcaggcgatt

SEQ ID NO: 744336 - DNA, 13 bp, C. elegans
ttttcagggattt

SEQ ID NO: 744337 - DNA, 13 bp, C. elegans
ttttcaggtaaaa

SEQ ID NO: 744338 - DNA, 13 bp, C. elegans
ttttcaggtaatt

SEQ ID NO: 744339 - DNA, 13 bp, C. elegans
ttttcaggtggaa

SEQ ID NO: 744340 - DNA, 13 bp, C. elegans
ttttcaggttaaa

SEQ ID NO: 744341 - DNA, 13 bp, C. elegans
ttttcaggttcaa

SEQ ID NO: 744342 - DNA, 13 bp, C. elegans
ttttcaggtttaa

SEQ ID NO: 744343 - DNA, 13 bp, C. elegans
ttttcaggtttca

SEQ ID NO: 744344 - DNA, 13 bp, C. elegans
ttttcagtaaaaa

SEQ ID NO: 744345 - DNA, 13 bp, C. elegans
ttttcagtacttt

SEQ ID NO: 744346 - DNA, 13 bp, C. elegans
ttttcagtagtat

SEQ ID NO: 744347 - DNA, 13 bp, C. elegans
ttttcagtataaa

SEQ ID NO: 744348 - DNA, 13 bp, C. elegans
ttttcagtatatt

SEQ ID NO: 744349 - DNA, 13 bp, C. elegans
ttttcagtatgaa

SEQ ID NO: 744350 - DNA, 13 bp, C. elegans
ttttcagtattta

SEQ ID NO: 744351 - DNA, 13 bp, C. elegans
ttttcagtcaaaa

SEQ ID NO: 744352 - DNA, 13 bp, C. elegans
ttttcagtcaatt

SEQ ID NO: 744353 - DNA, 13 bp, C. elegans
ttttcagtcacaa

SEQ ID NO: 744354 - DNA, 13 bp, C. elegans
ttttcagtcactt

SEQ ID NO: 744355 - DNA, 13 bp, C. elegans
ttttcagtcattt

SEQ ID NO: 744356 - DNA, 13 bp, C. elegans
ttttcagtcgaaa

SEQ ID NO: 744357 - DNA, 13 bp, C. elegans
ttttcagtcgaat

SEQ ID NO: 744358 - DNA, 13 bp, C. elegans
ttttcagtgaaaa

SEQ ID NO: 744359 - DNA, 13 bp, C. elegans
ttttcagtgcaaa

SEQ ID NO: 744360 - DNA, 13 bp, C. elegans
ttttcagtgcttt

SEQ ID NO: 744361 - DNA, 13 bp, C. elegans
ttttcagtggaaa

SEQ ID NO: 744362 - DNA, 13 bp, C. elegans
ttttcagtgtaaa

SEQ ID NO: 744363 - DNA, 13 bp, C. elegans
ttttcagtgtatt

SEQ ID NO: 744364 - DNA, 13 bp, C. elegans
ttttcagtgttga

SEQ ID NO: 744365 - DNA, 13 bp, C. elegans
ttttcagtgtttc

SEQ ID NO: 744366 - DNA, 13 bp, C. elegans
ttttcagttaaaa

SEQ ID NO: 744367 - DNA, 13 bp, C. elegans
ttttcagttatat

SEQ ID NO: 744368 - DNA, 13 bp, C. elegans
ttttcagttcaaa

SEQ ID NO: 744369 - DNA, 13 bp, C. elegans
ttttcagttcaag

SEQ ID NO: 744370 - DNA, 13 bp, C. elegans
ttttcagttcatt

SEQ ID NO: 744371 - DNA, 13 bp, C. elegans
ttttcagttcgaa

SEQ ID NO: 744372 - DNA, 13 bp, C. elegans
ttttcagttgaaa

SEQ ID NO: 744373 - DNA, 13 bp, C. elegans
ttttcagtttcaa

SEQ ID NO: 744374 - DNA, 13 bp, C. elegans
ttttcagtttcag

SEQ ID NO: 744375 - DNA, 13 bp, C. elegans
ttttcagttttca

SEQ ID NO: 744376 - DNA, 13 bp, C. elegans
ttttcagttttga

SEQ ID NO: 744377 - DNA, 13 bp, C. elegans
ttttcataaagtt

SEQ ID NO: 744378 - DNA, 13 bp, C. elegans
ttttcataaatag

SEQ ID NO: 744379 - DNA, 13 bp, C. elegans
ttttcataagatt

SEQ ID NO: 744380 - DNA, 13 bp, C. elegans
ttttcataagttt

SEQ ID NO: 744381 - DNA, 13 bp, C. elegans
ttttcataatttg

SEQ ID NO: 744382 - DNA, 13 bp, C. elegans
ttttcatacattc

SEQ ID NO: 744383 - DNA, 13 bp, C. elegans
ttttcatagaaaa

SEQ ID NO: 744384 - DNA, 13 bp, C. elegans
ttttcatagaatt

SEQ ID NO: 744385 - DNA, 13 bp, C. elegans
ttttcatagcttt

SEQ ID NO: 744386 - DNA, 13 bp, C. elegans
ttttcataggaat

SEQ ID NO: 744387 - DNA, 13 bp, C. elegans
ttttcataggttt

SEQ ID NO: 744388 - DNA, 13 bp, C. elegans
ttttcatataaac

SEQ ID NO: 744389 - DNA, 13 bp, C. elegans
ttttcatatacat

SEQ ID NO: 744390 - DNA, 13 bp, C. elegans
ttttcatatagtt

SEQ ID NO: 744391 - DNA, 13 bp, C. elegans
ttttcatatcaat

SEQ ID NO: 744392 - DNA, 13 bp, C. elegans
ttttcatatgaaa

SEQ ID NO: 744393 - DNA, 13 bp, C. elegans
ttttcatatgttc

SEQ ID NO: 744394 - DNA, 13 bp, C. elegans
ttttcatattaca

SEQ ID NO: 744395 - DNA, 13 bp, C. elegans
ttttcatattcca

SEQ ID NO: 744396 - DNA, 13 bp, C. elegans
ttttcatatttgc

SEQ ID NO: 744397 - DNA, 13 bp, C. elegans
ttttcatcaaata

SEQ ID NO: 744398 - DNA, 13 bp, C. elegans
ttttcatcaaatt

SEQ ID NO: 744399 - DNA, 13 bp, C. elegans
ttttcatcaagaa

SEQ ID NO: 744400 - DNA, 13 bp, C. elegans
ttttcatcaatat

SEQ ID NO: 744401 - DNA, 13 bp, C. elegans
ttttcatcaattc

SEQ ID NO: 744402 - DNA, 13 bp, C. elegans
ttttcatcacaaa

SEQ ID NO: 744403 - DNA, 13 bp, C. elegans
ttttcatcagaaa

SEQ ID NO: 744404 - DNA, 13 bp, C. elegans
ttttcatcagatt

SEQ ID NO: 744405 - DNA, 13 bp, C. elegans
ttttcatcataaa

SEQ ID NO: 744406 - DNA, 13 bp, C. elegans
ttttcatcattgt

SEQ ID NO: 744407 - DNA, 13 bp, C. elegans
ttttcatcatttg

SEQ ID NO: 744408 - DNA, 13 bp, C. elegans
ttttcatccaatt

SEQ ID NO: 744409 - DNA, 13 bp, C. elegans
ttttcatcgaaaa

SEQ ID NO: 744410 - DNA, 13 bp, C. elegans
ttttcatcggaga

SEQ ID NO: 744411 - DNA, 13 bp, C. elegans
ttttcatcggttt

SEQ ID NO: 744412 - DNA, 13 bp, C. elegans
ttttcatctaaaa

SEQ ID NO: 744413 - DNA, 13 bp, C. elegans
ttttcatctgaat

SEQ ID NO: 744414 - DNA, 13 bp, C. elegans
ttttcatctggaa

SEQ ID NO: 744415 - DNA, 13 bp, C. elegans
ttttcatgaaatt

SEQ ID NO: 744416 - DNA, 13 bp, C. elegans
ttttcatgaattt

SEQ ID NO: 744417 - DNA, 13 bp, C. elegans
ttttcatgagatt

SEQ ID NO: 744418 - DNA, 13 bp, C. elegans
ttttcatgataat

SEQ ID NO: 744419 - DNA, 13 bp, C. elegans
ttttcatgatgaa

SEQ ID NO: 744420 - DNA, 13 bp, C. elegans
ttttcatgattat

SEQ ID NO: 744421 - DNA, 13 bp, C. elegans
ttttcatgattca

SEQ ID NO: 744422 - DNA, 13 bp, C. elegans
ttttcatggaatt

SEQ ID NO: 744423 - DNA, 13 bp, C. elegans
ttttcatggattt

SEQ ID NO: 744424 - DNA, 13 bp, C. elegans
ttttcatgtaaaa

SEQ ID NO: 744425 - DNA, 13 bp, C. elegans
ttttcatgtaatt

SEQ ID NO: 744426 - DNA, 13 bp, C. elegans
ttttcatgtagaa

SEQ ID NO: 744427 - DNA, 13 bp, C. elegans
ttttcatgtatat

SEQ ID NO: 744428 - DNA, 13 bp, C. elegans
ttttcatgtcaaa

SEQ ID NO: 744429 - DNA, 13 bp, C. elegans
ttttcatgtcatt

SEQ ID NO: 744430 - DNA, 13 bp, C. elegans
ttttcatgtgaaa

SEQ ID NO: 744431 - DNA, 13 bp, C. elegans
ttttcatgttaaa

SEQ ID NO: 744432 - DNA, 13 bp, C. elegans
ttttcatgttcat

SEQ ID NO: 744433 - DNA, 13 bp, C. elegans
ttttcatgttctc

SEQ ID NO: 744434 - DNA, 13 bp, C. elegans
ttttcattaaaag

SEQ ID NO: 744435 - DNA, 13 bp, C. elegans
ttttcattaaatg

SEQ ID NO: 744436 - DNA, 13 bp, C. elegans
ttttcattagaaa

SEQ ID NO: 744437 - DNA, 13 bp, C. elegans
ttttcattattga

SEQ ID NO: 744438 - DNA, 13 bp, C. elegans
ttttcattcaaaa

SEQ ID NO: 744439 - DNA, 13 bp, C. elegans
ttttcattcaatg

SEQ ID NO: 744440 - DNA, 13 bp, C. elegans
ttttcattcacaa

SEQ ID NO: 744441 - DNA, 14 bp, C. elegans
ttttcattctgaaa

SEQ ID NO: 744442 - DNA, 13 bp, C. elegans
ttttcattgaaaa

SEQ ID NO: 744443 - DNA, 13 bp, C. elegans
ttttcattgaaag

SEQ ID NO: 744444 - DNA, 13 bp, C. elegans
ttttcattgaaat

SEQ ID NO: 744445 - DNA, 13 bp, C. elegans
ttttcattgtgaa

SEQ ID NO: 744446 - DNA, 13 bp, C. elegans
ttttcattgtgat

SEQ ID NO: 744447 - DNA, 13 bp, C. elegans
ttttcattgttaa

SEQ ID NO: 744448 - DNA, 13 bp, C. elegans
ttttcattgttca

SEQ ID NO: 744449 - DNA, 13 bp, C. elegans
ttttcatttcaaa

SEQ ID NO: 744450 - DNA, 13 bp, C. elegans
ttttcatttccag

SEQ ID NO: 744451 - DNA, 13 bp, C. elegans
ttttcatttgaaa

SEQ ID NO: 744452 - DNA, 13 bp, C. elegans
ttttcatttgaat

SEQ ID NO: 744453 - DNA, 13 bp, C. elegans
ttttcatttgagt

SEQ ID NO: 744454 - DNA, 13 bp, C. elegans
ttttcattttaga

SEQ ID NO: 744455 - DNA, 13 bp, C. elegans
ttttcattttcag

SEQ ID NO: 744456 - DNA, 13 bp, C. elegans
ttttcattttcgg

SEQ ID NO: 744457 - DNA, 13 bp, C. elegans
ttttcattttgag

SEQ ID NO: 744458 - DNA, 13 bp, C. elegans
ttttcattttgca

SEQ ID NO: 744459 - DNA, 13 bp, C. elegans
ttttccaaaaaca

SEQ ID NO: 744460 - DNA, 13 bp, C. elegans
ttttccaaaaacc

SEQ ID NO: 744461 - DNA, 13 bp, C. elegans
ttttccaaaaatc

SEQ ID NO: 744462 - DNA, 13 bp, C. elegans
ttttccaaaaatt

SEQ ID NO: 744463 - DNA, 13 bp, C. elegans
ttttccaaaactt

SEQ ID NO: 744464 - DNA, 13 bp, C. elegans
ttttccaaaagct

SEQ ID NO: 744465 - DNA, 13 bp, C. elegans
ttttccaaaatta

SEQ ID NO: 744466 - DNA, 13 bp, C. elegans
ttttccaaaattc

SEQ ID NO: 744467 - DNA, 13 bp, C. elegans
ttttccaaaattg

SEQ ID NO: 744468 - DNA, 13 bp, C. elegans
ttttccaaaattt

SEQ ID NO: 744469 - DNA, 13 bp, C. elegans
ttttccaaacaca

SEQ ID NO: 744470 - DNA, 13 bp, C. elegans
ttttccaaacttt

SEQ ID NO: 744471 - DNA, 13 bp, C. elegans
ttttccaaagaaa

SEQ ID NO: 744472 - DNA, 13 bp, C. elegans
ttttccaaagaat

SEQ ID NO: 744473 - DNA, 13 bp, C. elegans
ttttccaaagttc

SEQ ID NO: 744474 - DNA, 13 bp, C. elegans
ttttccaaataac

SEQ ID NO: 744475 - DNA, 13 bp, C. elegans
ttttccaaatatg

SEQ ID NO: 744476 - DNA, 13 bp, C. elegans
ttttccaaatatt

SEQ ID NO: 744477 - DNA, 13 bp, C. elegans
ttttccaaatctg

SEQ ID NO: 744478 - DNA, 13 bp, C. elegans
ttttccaaattaa

SEQ ID NO: 744479 - DNA, 13 bp, C. elegans
ttttccaaattgc

SEQ ID NO: 744480 - DNA, 13 bp, C. elegans
ttttccaaattta

SEQ ID NO: 744481 - DNA, 13 bp, C. elegans
ttttccaaatttc

SEQ ID NO: 744482 - DNA, 14 bp, C. elegans
ttttccaaatttcc

SEQ ID NO: 744483 - DNA, 13 bp, C. elegans
ttttccaacaaat

SEQ ID NO: 744484 - DNA, 13 bp, C. elegans
ttttccaacaatt

SEQ ID NO: 744485 - DNA, 13 bp, C. elegans
ttttccaacacaa

SEQ ID NO: 744486 - DNA, 13 bp, C. elegans
ttttccaacattc

SEQ ID NO: 744487 - DNA, 13 bp, C. elegans
ttttccaacattt

SEQ ID NO: 744488 - DNA, 13 bp, C. elegans
ttttccaacgaaa

SEQ ID NO: 744489 - DNA, 13 bp, C. elegans
ttttccaactaac

SEQ ID NO: 744490 - DNA, 13 bp, C. elegans
ttttccaactaat

SEQ ID NO: 744491 - DNA, 14 bp, C. elegans
ttttccaactggtt

SEQ ID NO: 744492 - DNA, 13 bp, C. elegans
ttttccaacttaa

SEQ ID NO: 744493 - DNA, 13 bp, C. elegans
ttttccaacttat

SEQ ID NO: 744494 - DNA, 13 bp, C. elegans
ttttccaactttc

SEQ ID NO: 744495 - DNA, 13 bp, C. elegans
ttttccaagaaaa

SEQ ID NO: 744496 - DNA, 13 bp, C. elegans
ttttccaaggaaa

SEQ ID NO: 744497 - DNA, 13 bp, C. elegans
ttttccaaggatt

SEQ ID NO: 744498 - DNA, 13 bp, C. elegans
ttttccaaggttt

SEQ ID NO: 744499 - DNA, 13 bp, C. elegans
ttttccaagtttt

SEQ ID NO: 744500 - DNA, 13 bp, C. elegans
ttttccaataata

SEQ ID NO: 744501 - DNA, 13 bp, C. elegans
ttttccaatcaaa

SEQ ID NO: 744502 - DNA, 13 bp, C. elegans
ttttccaatcagc

SEQ ID NO: 744503 - DNA, 14 bp, C. elegans
ttttccaatcattt

SEQ ID NO: 744504 - DNA, 13 bp, C. elegans
ttttccaatcttc

SEQ ID NO: 744505 - DNA, 13 bp, C. elegans
ttttccaatggaa

SEQ ID NO: 744506 - DNA, 13 bp, C. elegans
ttttccaatgttt

SEQ ID NO: 744507 - DNA, 13 bp, C. elegans
ttttccaattaat

SEQ ID NO: 744508 - DNA, 13 bp, C. elegans
ttttccaattcaa

SEQ ID NO: 744509 - DNA, 13 bp, C. elegans
ttttccaattcca

SEQ ID NO: 744510 - DNA, 13 bp, C. elegans
ttttccaattctg

SEQ ID NO: 744511 - DNA, 13 bp, C. elegans
ttttccaattgtt

SEQ ID NO: 744512 - DNA, 13 bp, C. elegans
ttttccaattttg

SEQ ID NO: 744513 - DNA, 13 bp, C. elegans
ttttccacaaaaa

SEQ ID NO: 744514 - DNA, 13 bp, C. elegans
ttttccacaaatc

SEQ ID NO: 744515 - DNA, 13 bp, C. elegans
ttttccacaaatt

SEQ ID NO: 744516 - DNA, 14 bp, C. elegans
ttttccacaatttc

SEQ ID NO: 744517 - DNA, 13 bp, C. elegans
ttttccacacttt

SEQ ID NO: 744518 - DNA, 13 bp, C. elegans
ttttccacataaa

SEQ ID NO: 744519 - DNA, 13 bp, C. elegans
ttttccacatatt

SEQ ID NO: 744520 - DNA, 13 bp, C. elegans
ttttccacatttc

SEQ ID NO: 744521 - DNA, 13 bp, C. elegans
ttttccacgcgtt

SEQ ID NO: 744522 - DNA, 13 bp, C. elegans
ttttccacggaga

SEQ ID NO: 744523 - DNA, 13 bp, C. elegans
ttttccacgtctt

SEQ ID NO: 744524 - DNA, 13 bp, C. elegans
ttttccacgtttt

SEQ ID NO: 744525 - DNA, 13 bp, C. elegans
ttttccactaaaa

SEQ ID NO: 744526 - DNA, 13 bp, C. elegans
ttttccactgaat

SEQ ID NO: 744527 - DNA, 13 bp, C. elegans
ttttccactgata

SEQ ID NO: 744528 - DNA, 13 bp, C. elegans
ttttccactgatt

SEQ ID NO: 744529 - DNA, 13 bp, C. elegans
ttttccactgttt

SEQ ID NO: 744530 - DNA, 13 bp, C. elegans
ttttccacttcta

SEQ ID NO: 744531 - DNA, 13 bp, C. elegans
ttttccacttttg

SEQ ID NO: 744532 - DNA, 13 bp, C. elegans
ttttccagaaaaa

SEQ ID NO: 744533 - DNA, 13 bp, C. elegans
ttttccagaaaac

SEQ ID NO: 744534 - DNA, 13 bp, C. elegans
ttttccagaaaat

SEQ ID NO: 744535 - DNA, 13 bp, C. elegans
ttttccagaaata

SEQ ID NO: 744536 - DNA, 13 bp, C. elegans
ttttccagaaatg

SEQ ID NO: 744537 - DNA, 13 bp, C. elegans
ttttccagaaatt

SEQ ID NO: 744538 - DNA, 13 bp, C. elegans
ttttccagaacct

SEQ ID NO: 744539 - DNA, 13 bp, C. elegans
ttttccagaattt

SEQ ID NO: 744540 - DNA, 13 bp, C. elegans
ttttccagagaaa

SEQ ID NO: 744541 - DNA, 13 bp, C. elegans
ttttccagagaat

SEQ ID NO: 744542 - DNA, 13 bp, C. elegans
ttttccagattaa

SEQ ID NO: 744543 - DNA, 13 bp, C. elegans
ttttccagccatt

SEQ ID NO: 744544 - DNA, 13 bp, C. elegans
ttttccagctcaa

SEQ ID NO: 744545 - DNA, 13 bp, C. elegans
ttttccagctttt

SEQ ID NO: 744546 - DNA, 13 bp, C. elegans
ttttccaggaaaa

SEQ ID NO: 744547 - DNA, 13 bp, C. elegans
ttttccaggtttt

SEQ ID NO: 744548 - DNA, 13 bp, C. elegans
ttttccagtactt

SEQ ID NO: 744549 - DNA, 13 bp, C. elegans
ttttccagtagaa

SEQ ID NO: 744550 - DNA, 13 bp, C. elegans
ttttccagtgcaa

SEQ ID NO: 744551 - DNA, 13 bp, C. elegans
ttttccagtgttt

SEQ ID NO: 744552 - DNA, 13 bp, C. elegans
ttttccagttaca

SEQ ID NO: 744553 - DNA, 13 bp, C. elegans
ttttccagttttc

SEQ ID NO: 744554 - DNA, 13 bp, C. elegans
ttttccataaaaa

SEQ ID NO: 744555 - DNA, 13 bp, C. elegans
ttttccatagttt

SEQ ID NO: 744556 - DNA, 13 bp, C. elegans
ttttccatattgt

SEQ ID NO: 744557 - DNA, 13 bp, C. elegans
ttttccatatttg

SEQ ID NO: 744558 - DNA, 13 bp, C. elegans
ttttccatcaaaa

SEQ ID NO: 744559 - DNA, 13 bp, C. elegans
ttttccatccata

SEQ ID NO: 744560 - DNA, 13 bp, C. elegans
ttttccatctgaa

SEQ ID NO: 744561 - DNA, 13 bp, C. elegans
ttttccatgaaaa

SEQ ID NO: 744562 - DNA, 13 bp, C. elegans
ttttccatggaaa

SEQ ID NO: 744563 - DNA, 13 bp, C. elegans
ttttccattaaaa

SEQ ID NO: 744564 - DNA, 13 bp, C. elegans
ttttccattcaaa

SEQ ID NO: 744565 - DNA, 13 bp, C. elegans
ttttccattcaat

SEQ ID NO: 744566 - DNA, 13 bp, C. elegans
ttttccattccgg

SEQ ID NO: 744567 - DNA, 13 bp, C. elegans
ttttccattgaaa

SEQ ID NO: 744568 - DNA, 13 bp, C. elegans
ttttccatttcca

SEQ ID NO: 744569 - DNA, 13 bp, C. elegans
ttttccattttag

SEQ ID NO: 744570 - DNA, 13 bp, C. elegans
ttttcccaaaaaa

SEQ ID NO: 744571 - DNA, 13 bp, C. elegans
ttttcccaaaaat

SEQ ID NO: 744572 - DNA, 13 bp, C. elegans
ttttcccaaacta

SEQ ID NO: 744573 - DNA, 13 bp, C. elegans
ttttcccaaatct

SEQ ID NO: 744574 - DNA, 13 bp, C. elegans
ttttcccaacaaa

SEQ ID NO: 744575 - DNA, 13 bp, C. elegans
ttttcccaataaa

SEQ ID NO: 744576 - DNA, 13 bp, C. elegans
ttttcccaatgtt

SEQ ID NO: 744577 - DNA, 13 bp, C. elegans
ttttcccaatttg

SEQ ID NO: 744578 - DNA, 13 bp, C. elegans
ttttcccaccaaa

SEQ ID NO: 744579 - DNA, 13 bp, C. elegans
ttttcccagaaaa

SEQ ID NO: 744580 - DNA, 13 bp, C. elegans
ttttcccagtttt

SEQ ID NO: 744581 - DNA, 13 bp, C. elegans
ttttcccataaaa

SEQ ID NO: 744582 - DNA, 13 bp, C. elegans
ttttcccatgaaa

SEQ ID NO: 744583 - DNA, 13 bp, C. elegans
ttttcccattcaa

SEQ ID NO: 744584 - DNA, 13 bp, C. elegans
ttttcccattcat

SEQ ID NO: 744585 - DNA, 13 bp, C. elegans
ttttcccattcca

SEQ ID NO: 744586 - DNA, 13 bp, C. elegans
ttttcccattgat

SEQ ID NO: 744587 - DNA, 13 bp, C. elegans
ttttcccatttca

SEQ ID NO: 744588 - DNA, 13 bp, C. elegans
ttttcccatttgt

SEQ ID NO: 744589 - DNA, 13 bp, C. elegans
ttttccccaaaca

SEQ ID NO: 744590 - DNA, 18 bp, C. elegans
ttttccccaattttcccc

SEQ ID NO: 744591 - DNA, 13 bp, C. elegans
ttttccccacatt

SEQ ID NO: 744592 - DNA, 13 bp, C. elegans
ttttccccactgg

SEQ ID NO: 744593 - DNA, 13 bp, C. elegans
ttttccccagttt

SEQ ID NO: 744594 - DNA, 13 bp, C. elegans
ttttcccccagaa

SEQ ID NO: 744595 - DNA, 13 bp, C. elegans
ttttcccccgaaa

SEQ ID NO: 744596 - DNA, 13 bp, C. elegans
ttttccccgattt

SEQ ID NO: 744597 - DNA, 13 bp, C. elegans
ttttccccggaaa

SEQ ID NO: 744598 - DNA, 13 bp, C. elegans
ttttccccgttga

SEQ ID NO: 744599 - DNA, 13 bp, C. elegans
ttttcccctaaaa

SEQ ID NO: 744600 - DNA, 14 bp, C. elegans
ttttcccctaattc

SEQ ID NO: 744601 - DNA, 13 bp, C. elegans
ttttcccctgatt

SEQ ID NO: 744602 - DNA, 13 bp, C. elegans
ttttcccgaataa

SEQ ID NO: 744603 - DNA, 13 bp, C. elegans
ttttcccgataat

SEQ ID NO: 744604 - DNA, 13 bp, C. elegans
ttttcccggaaaa

SEQ ID NO: 744605 - DNA, 13 bp, C. elegans
ttttcccgtaata

SEQ ID NO: 744606 - DNA, 13 bp, C. elegans
ttttccctaaaaa

SEQ ID NO: 744607 - DNA, 13 bp, C. elegans
ttttccctccaaa

SEQ ID NO: 744608 - DNA, 13 bp, C. elegans
ttttcccttgaaa

SEQ ID NO: 744609 - DNA, 13 bp, C. elegans
ttttccgaaaact

SEQ ID NO: 744610 - DNA, 13 bp, C. elegans
ttttccgaaaatt

SEQ ID NO: 744611 - DNA, 13 bp, C. elegans
ttttccgaaagtt

SEQ ID NO: 744612 - DNA, 13 bp, C. elegans
ttttccgaaataa

SEQ ID NO: 744613 - DNA, 13 bp, C. elegans
ttttccgaaatcc

SEQ ID NO: 744614 - DNA, 13 bp, C. elegans
ttttccgaattct

SEQ ID NO: 744615 - DNA, 13 bp, C. elegans
ttttccgaattta

SEQ ID NO: 744616 - DNA, 13 bp, C. elegans
ttttccgaatttg

SEQ ID NO: 744617 - DNA, 13 bp, C. elegans
ttttccgacaaaa

SEQ ID NO: 744618 - DNA, 13 bp, C. elegans
ttttccgacaaat

SEQ ID NO: 744619 - DNA, 13 bp, C. elegans
ttttccgactgaa

SEQ ID NO: 744620 - DNA, 13 bp, C. elegans
ttttccgactttt

SEQ ID NO: 744621 - DNA, 13 bp, C. elegans
ttttccgagaaaa

SEQ ID NO: 744622 - DNA, 13 bp, C. elegans
ttttccgagtttc

SEQ ID NO: 744623 - DNA, 13 bp, C. elegans
ttttccgataata

SEQ ID NO: 744624 - DNA, 13 bp, C. elegans
ttttccgatcaaa

SEQ ID NO: 744625 - DNA, 13 bp, C. elegans
ttttccgatttca

SEQ ID NO: 744626 - DNA, 13 bp, C. elegans
ttttccgcaaaaa

SEQ ID NO: 744627 - DNA, 13 bp, C. elegans
ttttccgcatttt

SEQ ID NO: 744628 - DNA, 13 bp, C. elegans
ttttccgccaaaa

SEQ ID NO: 744629 - DNA, 13 bp, C. elegans
ttttccgccaatt

SEQ ID NO: 744630 - DNA, 13 bp, C. elegans
ttttccgcccacc

SEQ ID NO: 744631 - DNA, 13 bp, C. elegans
ttttccgccgaaa

SEQ ID NO: 744632 - DNA, 13 bp, C. elegans
ttttccgccggtt

SEQ ID NO: 744633 - DNA, 15 bp, C. elegans
ttttccgcctgtttt

SEQ ID NO: 744634 - DNA, 13 bp, C. elegans
ttttccgcggaaa

SEQ ID NO: 744635 - DNA, 13 bp, C. elegans
ttttccgctcaaa

SEQ ID NO: 744636 - DNA, 13 bp, C. elegans
ttttccggaaaaa

SEQ ID NO: 744637 - DNA, 13 bp, C. elegans
ttttccggaaatt

SEQ ID NO: 744638 - DNA, 13 bp, C. elegans
ttttccggctaaa

SEQ ID NO: 744639 - DNA, 13 bp, C. elegans
ttttccgggaaaa

SEQ ID NO: 744640 - DNA, 13 bp, C. elegans
ttttccggtaatt

SEQ ID NO: 744641 - DNA, 13 bp, C. elegans
ttttccggtgaaa

SEQ ID NO: 744642 - DNA, 13 bp, C. elegans
ttttccggtttca

SEQ ID NO: 744643 - DNA, 13 bp, C. elegans
ttttccgtaaaaa

SEQ ID NO: 744644 - DNA, 13 bp, C. elegans
ttttccgtaattt

SEQ ID NO: 744645 - DNA, 13 bp, C. elegans
ttttccgtagaaa

SEQ ID NO: 744646 - DNA, 13 bp, C. elegans
ttttccgtatttc

SEQ ID NO: 744647 - DNA, 13 bp, C. elegans
ttttccgtcgaaa

SEQ ID NO: 744648 - DNA, 13 bp, C. elegans
ttttccgtgtcaa

SEQ ID NO: 744649 - DNA, 13 bp, C. elegans
ttttccgtgtcac

SEQ ID NO: 744650 - DNA, 13 bp, C. elegans
ttttccgttaaaa

SEQ ID NO: 744651 - DNA, 13 bp, C. elegans
ttttccgttccca

SEQ ID NO: 744652 - DNA, 13 bp, C. elegans
ttttcctaaaaat

SEQ ID NO: 744653 - DNA, 13 bp, C. elegans
ttttcctaaattc

SEQ ID NO: 744654 - DNA, 13 bp, C. elegans
ttttcctaataaa

SEQ ID NO: 744655 - DNA, 13 bp, C. elegans
ttttcctacaaaa

SEQ ID NO: 744656 - DNA, 13 bp, C. elegans
ttttcctagaatt

SEQ ID NO: 744657 - DNA, 13 bp, C. elegans
ttttcctatgaaa

SEQ ID NO: 744658 - DNA, 13 bp, C. elegans
ttttcctatttga

SEQ ID NO: 744659 - DNA, 13 bp, C. elegans
ttttcctcaaaaa

SEQ ID NO: 744660 - DNA, 13 bp, C. elegans
ttttcctcaaatt

SEQ ID NO: 744661 - DNA, 13 bp, C. elegans
ttttcctcaattc

SEQ ID NO: 744662 - DNA, 13 bp, C. elegans
ttttcctcacaaa

SEQ ID NO: 744663 - DNA, 13 bp, C. elegans
ttttcctcacgtt

SEQ ID NO: 744664 - DNA, 13 bp, C. elegans
ttttcctcgaaaa

SEQ ID NO: 744665 - DNA, 13 bp, C. elegans
ttttcctcgaaat

SEQ ID NO: 744666 - DNA, 13 bp, C. elegans
ttttcctctaaaa

SEQ ID NO: 744667 - DNA, 13 bp, C. elegans
ttttcctctcaaa

SEQ ID NO: 744668 - DNA, 13 bp, C. elegans
ttttcctctcaat

SEQ ID NO: 744669 - DNA, 13 bp, C. elegans
ttttcctctgatt

SEQ ID NO: 744670 - DNA, 13 bp, C. elegans
ttttcctgaaaaa

SEQ ID NO: 744671 - DNA, 13 bp, C. elegans
ttttcctgaaaca

SEQ ID NO: 744672 - DNA, 14 bp, C. elegans
ttttcctgaatttc

SEQ ID NO: 744673 - DNA, 13 bp, C. elegans
ttttcctgcaaaa

SEQ ID NO: 744674 - DNA, 13 bp, C. elegans
ttttcctgcattt

SEQ ID NO: 744675 - DNA, 13 bp, C. elegans
ttttcctgctgaa

SEQ ID NO: 744676 - DNA, 13 bp, C. elegans
ttttcctggaaaa

SEQ ID NO: 744677 - DNA, 13 bp, C. elegans
ttttcctggaaat

SEQ ID NO: 744678 - DNA, 13 bp, C. elegans
ttttcctggaatt

SEQ ID NO: 744679 - DNA, 13 bp, C. elegans
ttttcctggacca

SEQ ID NO: 744680 - DNA, 13 bp, C. elegans
ttttcctgtgatt

SEQ ID NO: 744681 - DNA, 13 bp, C. elegans
ttttcctgttaaa

SEQ ID NO: 744682 - DNA, 13 bp, C. elegans
ttttcctgttcat

SEQ ID NO: 744683 - DNA, 13 bp, C. elegans
ttttcctgtttca

SEQ ID NO: 744684 - DNA, 13 bp, C. elegans
ttttccttaaaaa

SEQ ID NO: 744685 - DNA, 13 bp, C. elegans
ttttccttaataa

SEQ ID NO: 744686 - DNA, 13 bp, C. elegans
ttttccttataaa

SEQ ID NO: 744687 - DNA, 13 bp, C. elegans
ttttccttcaaaa

SEQ ID NO: 744688 - DNA, 13 bp, C. elegans
ttttccttcataa

SEQ ID NO: 744689 - DNA, 13 bp, C. elegans
ttttccttccaaa

SEQ ID NO: 744690 - DNA, 13 bp, C. elegans
ttttccttgaaaa

SEQ ID NO: 744691 - DNA, 13 bp, C. elegans
ttttccttgttaa

SEQ ID NO: 744692 - DNA, 13 bp, C. elegans
ttttccttttcag

SEQ ID NO: 744693 - DNA, 13 bp, C. elegans
ttttcgaaaaaaa

SEQ ID NO: 744694 - DNA, 13 bp, C. elegans
ttttcgaaaaaat

SEQ ID NO: 744695 - DNA, 13 bp, C. elegans
ttttcgaaaaata

SEQ ID NO: 744696 - DNA, 13 bp, C. elegans
ttttcgaaaaatc

SEQ ID NO: 744697 - DNA, 13 bp, C. elegans
ttttcgaaaaatg

SEQ ID NO: 744698 - DNA, 13 bp, C. elegans
ttttcgaaaaatt

SEQ ID NO: 744699 - DNA, 13 bp, C. elegans
ttttcgaaaacat

SEQ ID NO: 744700 - DNA, 13 bp, C. elegans
ttttcgaaaactc

SEQ ID NO: 744701 - DNA, 13 bp, C. elegans
ttttcgaaaagtt

SEQ ID NO: 744702 - DNA, 13 bp, C. elegans
ttttcgaaaattc

SEQ ID NO: 744703 - DNA, 13 bp, C. elegans
ttttcgaaaattg

SEQ ID NO: 744704 - DNA, 14 bp, C. elegans
ttttcgaaaatttt

SEQ ID NO: 744705 - DNA, 13 bp, C. elegans
ttttcgaaacata

SEQ ID NO: 744706 - DNA, 13 bp, C. elegans
ttttcgaaacatt

SEQ ID NO: 744707 - DNA, 13 bp, C. elegans
ttttcgaaacgaa

SEQ ID NO: 744708 - DNA, 13 bp, C. elegans
ttttcgaaagttc

SEQ ID NO: 744709 - DNA, 13 bp, C. elegans
ttttcgaaagttt

SEQ ID NO: 744710 - DNA, 13 bp, C. elegans
ttttcgaaataaa

SEQ ID NO: 744711 - DNA, 13 bp, C. elegans
ttttcgaaatgaa

SEQ ID NO: 744712 - DNA, 13 bp, C. elegans
ttttcgaaatgtt

SEQ ID NO: 744713 - DNA, 13 bp, C. elegans
ttttcgaaattca

SEQ ID NO: 744714 - DNA, 13 bp, C. elegans
ttttcgaaattga

SEQ ID NO: 744715 - DNA, 13 bp, C. elegans
ttttcgaaattta

SEQ ID NO: 744716 - DNA, 14 bp, C. elegans
ttttcgaaattttc

SEQ ID NO: 744717 - DNA, 13 bp, C. elegans
ttttcgaacgttt

SEQ ID NO: 744718 - DNA, 13 bp, C. elegans
ttttcgaactttt

SEQ ID NO: 744719 - DNA, 13 bp, C. elegans
ttttcgaagaaac

SEQ ID NO: 744720 - DNA, 13 bp, C. elegans
ttttcgaagaata

SEQ ID NO: 744721 - DNA, 13 bp, C. elegans
ttttcgaagagaa

SEQ ID NO: 744722 - DNA, 15 bp, C. elegans
ttttcgaagatcaaa

SEQ ID NO: 744723 - DNA, 13 bp, C. elegans
ttttcgaagtcat

SEQ ID NO: 744724 - DNA, 13 bp, C. elegans
ttttcgaagtttt

SEQ ID NO: 744725 - DNA, 13 bp, C. elegans
ttttcgaataaaa

SEQ ID NO: 744726 - DNA, 13 bp, C. elegans
ttttcgaataaca

SEQ ID NO: 744727 - DNA, 13 bp, C. elegans
ttttcgaataact

SEQ ID NO: 744728 - DNA, 13 bp, C. elegans
ttttcgaatcaaa

SEQ ID NO: 744729 - DNA, 13 bp, C. elegans
ttttcgaatgaaa

SEQ ID NO: 744730 - DNA, 13 bp, C. elegans
ttttcgaatgttt

SEQ ID NO: 744731 - DNA, 13 bp, C. elegans
ttttcgaattaaa

SEQ ID NO: 744732 - DNA, 13 bp, C. elegans
ttttcgaattcaa

SEQ ID NO: 744733 - DNA, 13 bp, C. elegans
ttttcgaattgaa

SEQ ID NO: 744734 - DNA, 13 bp, C. elegans
ttttcgaattgga

SEQ ID NO: 744735 - DNA, 13 bp, C. elegans
ttttcgaattgtt

SEQ ID NO: 744736 - DNA, 13 bp, C. elegans
ttttcgaatttaa

SEQ ID NO: 744737 - DNA, 13 bp, C. elegans
ttttcgaatttgg

SEQ ID NO: 744738 - DNA, 13 bp, C. elegans
ttttcgaatttta

SEQ ID NO: 744739 - DNA, 13 bp, C. elegans
ttttcgacaaaaa

SEQ ID NO: 744740 - DNA, 13 bp, C. elegans
ttttcgacaaatt

SEQ ID NO: 744741 - DNA, 13 bp, C. elegans
ttttcgacaattt

SEQ ID NO: 744742 - DNA, 13 bp, C. elegans
ttttcgacagaaa

SEQ ID NO: 744743 - DNA, 13 bp, C. elegans
ttttcgacatttg

SEQ ID NO: 744744 - DNA, 13 bp, C. elegans
ttttcgacatttt

SEQ ID NO: 744745 - DNA, 13 bp, C. elegans
ttttcgaccattt

SEQ ID NO: 744746 - DNA, 13 bp, C. elegans
ttttcgacccaaa

SEQ ID NO: 744747 - DNA, 13 bp, C. elegans
ttttcgacgaatt

SEQ ID NO: 744748 - DNA, 13 bp, C. elegans
ttttcgacggaaa

SEQ ID NO: 744749 - DNA, 13 bp, C. elegans
ttttcgacgtttt

SEQ ID NO: 744750 - DNA, 13 bp, C. elegans
ttttcgactaaaa

SEQ ID NO: 744751 - DNA, 13 bp, C. elegans
ttttcgactcaaa

SEQ ID NO: 744752 - DNA, 13 bp, C. elegans
ttttcgactttat

SEQ ID NO: 744753 - DNA, 13 bp, C. elegans
ttttcgactttta

SEQ ID NO: 744754 - DNA, 13 bp, C. elegans
ttttcgacttttc

SEQ ID NO: 744755 - DNA, 14 bp, C. elegans
ttttcgagaaaaat

SEQ ID NO: 744756 - DNA, 13 bp, C. elegans
ttttcgagaaaat

SEQ ID NO: 744757 - DNA, 13 bp, C. elegans
ttttcgagaaact

SEQ ID NO: 744758 - DNA, 13 bp, C. elegans
ttttcgagaaatg

SEQ ID NO: 744759 - DNA, 13 bp, C. elegans
ttttcgagaaatt

SEQ ID NO: 744760 - DNA, 13 bp, C. elegans
ttttcgagaataa

SEQ ID NO: 744761 - DNA, 13 bp, C. elegans
ttttcgagaatct

SEQ ID NO: 744762 - DNA, 13 bp, C. elegans
ttttcgagacaaa

SEQ ID NO: 744763 - DNA, 13 bp, C. elegans
ttttcgagacttt

SEQ ID NO: 744764 - DNA, 13 bp, C. elegans
ttttcgagcaaaa

SEQ ID NO: 744765 - DNA, 13 bp, C. elegans
ttttcgagcgaaa

SEQ ID NO: 744766 - DNA, 13 bp, C. elegans
ttttcgagctatt

SEQ ID NO: 744767 - DNA, 13 bp, C. elegans
ttttcgagctttt

SEQ ID NO: 744768 - DNA, 13 bp, C. elegans
ttttcgaggaaat

SEQ ID NO: 744769 - DNA, 13 bp, C. elegans
ttttcgaggtttt

SEQ ID NO: 744770 - DNA, 13 bp, C. elegans
ttttcgagtaaat

SEQ ID NO: 744771 - DNA, 13 bp, C. elegans
ttttcgagtagaa

SEQ ID NO: 744772 - DNA, 13 bp, C. elegans
ttttcgagtgaat

SEQ ID NO: 744773 - DNA, 13 bp, C. elegans
ttttcgagtttca

SEQ ID NO: 744774 - DNA, 13 bp, C. elegans
ttttcgagttttg

SEQ ID NO: 744775 - DNA, 13 bp, C. elegans
ttttcgataaaat

SEQ ID NO: 744776 - DNA, 13 bp, C. elegans
ttttcgataaatt

SEQ ID NO: 744777 - DNA, 13 bp, C. elegans
ttttcgataactt

SEQ ID NO: 744778 - DNA, 13 bp, C. elegans
ttttcgatagaat

SEQ ID NO: 744779 - DNA, 13 bp, C. elegans
ttttcgatataat

SEQ ID NO: 744780 - DNA, 13 bp, C. elegans
ttttcgatatatt

SEQ ID NO: 744781 - DNA, 13 bp, C. elegans
ttttcgatatctc

SEQ ID NO: 744782 - DNA, 13 bp, C. elegans
ttttcgatattaa

SEQ ID NO: 744783 - DNA, 13 bp, C. elegans
ttttcgatattct

SEQ ID NO: 744784 - DNA, 13 bp, C. elegans
ttttcgatcaaaa

SEQ ID NO: 744785 - DNA, 13 bp, C. elegans
ttttcgatcaaat

SEQ ID NO: 744786 - DNA, 13 bp, C. elegans
ttttcgatcaatt

SEQ ID NO: 744787 - DNA, 13 bp, C. elegans
ttttcgatcgaaa

SEQ ID NO: 744788 - DNA, 13 bp, C. elegans
ttttcgatgacaa

SEQ ID NO: 744789 - DNA, 13 bp, C. elegans
ttttcgatgagaa

SEQ ID NO: 744790 - DNA, 13 bp, C. elegans
ttttcgatggttt

SEQ ID NO: 744791 - DNA, 13 bp, C. elegans
ttttcgatgtttc

SEQ ID NO: 744792 - DNA, 13 bp, C. elegans
ttttcgattaaaa

SEQ ID NO: 744793 - DNA, 13 bp, C. elegans
ttttcgattaatt

SEQ ID NO: 744794 - DNA, 13 bp, C. elegans
ttttcgattatct

SEQ ID NO: 744795 - DNA, 13 bp, C. elegans
ttttcgattcaaa

SEQ ID NO: 744796 - DNA, 13 bp, C. elegans
ttttcgatttaaa

SEQ ID NO: 744797 - DNA, 13 bp, C. elegans
ttttcgatttata

SEQ ID NO: 744798 - DNA, 13 bp, C. elegans
ttttcgatttcaa

SEQ ID NO: 744799 - DNA, 13 bp, C. elegans
ttttcgattttca

SEQ ID NO: 744800 - DNA, 13 bp, C. elegans
ttttcgcaaaatg

SEQ ID NO: 744801 - DNA, 13 bp, C. elegans
ttttcgcaaattt

SEQ ID NO: 744802 - DNA, 13 bp, C. elegans
ttttcgcaattta

SEQ ID NO: 744803 - DNA, 13 bp, C. elegans
ttttcgcagtttt

SEQ ID NO: 744804 - DNA, 13 bp, C. elegans
ttttcgcatgttt

SEQ ID NO: 744805 - DNA, 13 bp, C. elegans
ttttcgcatttaa

SEQ ID NO: 744806 - DNA, 13 bp, C. elegans
ttttcgcatttcc

SEQ ID NO: 744807 - DNA, 13 bp, C. elegans
ttttcgcattttc

SEQ ID NO: 744808 - DNA, 13 bp, C. elegans
ttttcgccaaaaa

SEQ ID NO: 744809 - DNA, 13 bp, C. elegans
ttttcgccaaatt

SEQ ID NO: 744810 - DNA, 13 bp, C. elegans
ttttcgccaactt

SEQ ID NO: 744811 - DNA, 13 bp, C. elegans
ttttcgccaattt

SEQ ID NO: 744812 - DNA, 13 bp, C. elegans
ttttcgccacttt

SEQ ID NO: 744813 - DNA, 13 bp, C. elegans
ttttcgccgaaat

SEQ ID NO: 744814 - DNA, 13 bp, C. elegans
ttttcgccggaaa

SEQ ID NO: 744815 - DNA, 13 bp, C. elegans
ttttcgcgaaaaa

SEQ ID NO: 744816 - DNA, 13 bp, C. elegans
ttttcgcgaaata

SEQ ID NO: 744817 - DNA, 13 bp, C. elegans
ttttcgcgaaatt

SEQ ID NO: 744818 - DNA, 13 bp, C. elegans
ttttcgcgcaaaa

SEQ ID NO: 744819 - DNA, 13 bp, C. elegans
ttttcgcgccaaa

SEQ ID NO: 744820 - DNA, 15 bp, C. elegans
ttttcgcgctccatt

SEQ ID NO: 744821 - DNA, 13 bp, C. elegans
ttttcgcggcggg

SEQ ID NO: 744822 - DNA, 13 bp, C. elegans
ttttcgctacgag

SEQ ID NO: 744823 - DNA, 13 bp, C. elegans
ttttcgctagttt

SEQ ID NO: 744824 - DNA, 13 bp, C. elegans
ttttcgctcaatt

SEQ ID NO: 744825 - DNA, 13 bp, C. elegans
ttttcgctgaaaa

SEQ ID NO: 744826 - DNA, 13 bp, C. elegans
ttttcgcttaaaa

SEQ ID NO: 744827 - DNA, 13 bp, C. elegans
ttttcgcttcaaa

SEQ ID NO: 744828 - DNA, 13 bp, C. elegans
ttttcgctttcaa

SEQ ID NO: 744829 - DNA, 13 bp, C. elegans
ttttcggaaaaaa

SEQ ID NO: 744830 - DNA, 13 bp, C. elegans
ttttcggaaaaat

SEQ ID NO: 744831 - DNA, 13 bp, C. elegans
ttttcggaaaata

SEQ ID NO: 744832 - DNA, 13 bp, C. elegans
ttttcggaaaatt

SEQ ID NO: 744833 - DNA, 13 bp, C. elegans
ttttcggaaataa

SEQ ID NO: 744834 - DNA, 13 bp, C. elegans
ttttcggaaattt

SEQ ID NO: 744835 - DNA, 13 bp, C. elegans
ttttcggaacaaa

SEQ ID NO: 744836 - DNA, 13 bp, C. elegans
ttttcggaagaaa

SEQ ID NO: 744837 - DNA, 13 bp, C. elegans
ttttcggaagttc

SEQ ID NO: 744838 - DNA, 13 bp, C. elegans
ttttcggaatgaa

SEQ ID NO: 744839 - DNA, 13 bp, C. elegans
ttttcggaattat

SEQ ID NO: 744840 - DNA, 13 bp, C. elegans
ttttcggaatttc

SEQ ID NO: 744841 - DNA, 13 bp, C. elegans
ttttcggaatttt

SEQ ID NO: 744842 - DNA, 13 bp, C. elegans
ttttcggacaatt

SEQ ID NO: 744843 - DNA, 13 bp, C. elegans
ttttcggactaaa

SEQ ID NO: 744844 - DNA, 13 bp, C. elegans
ttttcggagcgga

SEQ ID NO: 744845 - DNA, 13 bp, C. elegans
ttttcggataaaa

SEQ ID NO: 744846 - DNA, 13 bp, C. elegans
ttttcggatgttt

SEQ ID NO: 744847 - DNA, 13 bp, C. elegans
ttttcggattaaa

SEQ ID NO: 744848 - DNA, 13 bp, C. elegans
ttttcggatttaa

SEQ ID NO: 744849 - DNA, 13 bp, C. elegans
ttttcggcaaaaa

SEQ ID NO: 744850 - DNA, 13 bp, C. elegans
ttttcggcaaaat

SEQ ID NO: 744851 - DNA, 13 bp, C. elegans
ttttcggcaaccg

SEQ ID NO: 744852 - DNA, 13 bp, C. elegans
ttttcggcaactc

SEQ ID NO: 744853 - DNA, 13 bp, C. elegans
ttttcggcaactt

SEQ ID NO: 744854 - DNA, 13 bp, C. elegans
ttttcggcaatca

SEQ ID NO: 744855 - DNA, 13 bp, C. elegans
ttttcggcaattt

SEQ ID NO: 744856 - DNA, 13 bp, C. elegans
ttttcggcatatt

SEQ ID NO: 744857 - DNA, 13 bp, C. elegans
ttttcggcatttg

SEQ ID NO: 744858 - DNA, 13 bp, C. elegans
ttttcggcgaaaa

SEQ ID NO: 744859 - DNA, 13 bp, C. elegans
ttttcggcgggaa

SEQ ID NO: 744860 - DNA, 13 bp, C. elegans
ttttcggctaacg

SEQ ID NO: 744861 - DNA, 13 bp, C. elegans
ttttcggctattt

SEQ ID NO: 744862 - DNA, 13 bp, C. elegans
ttttcggctcaaa

SEQ ID NO: 744863 - DNA, 13 bp, C. elegans
ttttcggctgaaa

SEQ ID NO: 744864 - DNA, 13 bp, C. elegans
ttttcggctgtcg

SEQ ID NO: 744865 - DNA, 13 bp, C. elegans
ttttcgggaaaat

SEQ ID NO: 744866 - DNA, 13 bp, C. elegans
ttttcgggaattc

SEQ ID NO: 744867 - DNA, 13 bp, C. elegans
ttttcgggaattt

SEQ ID NO: 744868 - DNA, 13 bp, C. elegans
ttttcgggatttt

SEQ ID NO: 744869 - DNA, 13 bp, C. elegans
ttttcggggaaaa

SEQ ID NO: 744870 - DNA, 13 bp, C. elegans
ttttcggtaattg

SEQ ID NO: 744871 - DNA, 13 bp, C. elegans
ttttcggtcaaaa

SEQ ID NO: 744872 - DNA, 13 bp, C. elegans
ttttcggtccaaa

SEQ ID NO: 744873 - DNA, 13 bp, C. elegans
ttttcggtcgaaa

SEQ ID NO: 744874 - DNA, 13 bp, C. elegans
ttttcggtggaaa

SEQ ID NO: 744875 - DNA, 13 bp, C. elegans
ttttcggtggcct

SEQ ID NO: 744876 - DNA, 13 bp, C. elegans
ttttcggtgtaaa

SEQ ID NO: 744877 - DNA, 13 bp, C. elegans
ttttcggttcaaa

SEQ ID NO: 744878 - DNA, 13 bp, C. elegans
ttttcggttgaaa

SEQ ID NO: 744879 - DNA, 13 bp, C. elegans
ttttcgtaaaact

SEQ ID NO: 744880 - DNA, 13 bp, C. elegans
ttttcgtaattta

SEQ ID NO: 744881 - DNA, 13 bp, C. elegans
ttttcgtataata

SEQ ID NO: 744882 - DNA, 13 bp, C. elegans
ttttcgtcaaaaa

SEQ ID NO: 744883 - DNA, 13 bp, C. elegans
ttttcgtcaaagt

SEQ ID NO: 744884 - DNA, 13 bp, C. elegans
ttttcgtcaaatt

SEQ ID NO: 744885 - DNA, 13 bp, C. elegans
ttttcgtcattat

SEQ ID NO: 744886 - DNA, 13 bp, C. elegans
ttttcgtccaaaa

SEQ ID NO: 744887 - DNA, 13 bp, C. elegans
ttttcgtcgaaaa

SEQ ID NO: 744888 - DNA, 13 bp, C. elegans
ttttcgtcgaatt

SEQ ID NO: 744889 - DNA, 13 bp, C. elegans
ttttcgtgaaaac

SEQ ID NO: 744890 - DNA, 13 bp, C. elegans
ttttcgtgaattt

SEQ ID NO: 744891 - DNA, 13 bp, C. elegans
ttttcgtgagaaa

SEQ ID NO: 744892 - DNA, 13 bp, C. elegans
ttttcgtgcattt

SEQ ID NO: 744893 - DNA, 13 bp, C. elegans
ttttcgtgtaaaa

SEQ ID NO: 744894 - DNA, 13 bp, C. elegans
ttttcgtgttaaa

SEQ ID NO: 744895 - DNA, 13 bp, C. elegans
ttttcgttaaaaa

SEQ ID NO: 744896 - DNA, 13 bp, C. elegans
ttttcgttaaatt

SEQ ID NO: 744897 - DNA, 13 bp, C. elegans
ttttcgttaatta

SEQ ID NO: 744898 - DNA, 13 bp, C. elegans
ttttcgttacgag

SEQ ID NO: 744899 - DNA, 13 bp, C. elegans
ttttcgttcaaaa

SEQ ID NO: 744900 - DNA, 13 bp, C. elegans
ttttcgttgcaaa

SEQ ID NO: 744901 - DNA, 13 bp, C. elegans
ttttcgttggaaa

SEQ ID NO: 744902 - DNA, 13 bp, C. elegans
ttttcgtttcgag

SEQ ID NO: 744903 - DNA, 13 bp, C. elegans
ttttcgtttgaat

SEQ ID NO: 744904 - DNA, 13 bp, C. elegans
ttttcgttttaaa

SEQ ID NO: 744905 - DNA, 13 bp, C. elegans
ttttcgttttcga

SEQ ID NO: 744906 - DNA, 13 bp, C. elegans
ttttctaaaaact

SEQ ID NO: 744907 - DNA, 13 bp, C. elegans
ttttctaaaaatc

SEQ ID NO: 744908 - DNA, 13 bp, C. elegans
ttttctaaaaatg

SEQ ID NO: 744909 - DNA, 13 bp, C. elegans
ttttctaaaactc

SEQ ID NO: 744910 - DNA, 13 bp, C. elegans
ttttctaaaatcg

SEQ ID NO: 744911 - DNA, 13 bp, C. elegans
ttttctaaaatct

SEQ ID NO: 744912 - DNA, 13 bp, C. elegans
ttttctaaacaaa

SEQ ID NO: 744913 - DNA, 13 bp, C. elegans
ttttctaaacttc

SEQ ID NO: 744914 - DNA, 13 bp, C. elegans
ttttctaaatcaa

SEQ ID NO: 744915 - DNA, 13 bp, C. elegans
ttttctaaatgtt

SEQ ID NO: 744916 - DNA, 13 bp, C. elegans
ttttctaaatttg

SEQ ID NO: 744917 - DNA, 13 bp, C. elegans
ttttctaacaatt

SEQ ID NO: 744918 - DNA, 13 bp, C. elegans
ttttctaacagtt

SEQ ID NO: 744919 - DNA, 13 bp, C. elegans
ttttctaaccaat

SEQ ID NO: 744920 - DNA, 13 bp, C. elegans
ttttctaacgaaa

SEQ ID NO: 744921 - DNA, 13 bp, C. elegans
ttttctaactaat

SEQ ID NO: 744922 - DNA, 13 bp, C. elegans
ttttctaagaaaa

SEQ ID NO: 744923 - DNA, 13 bp, C. elegans
ttttctaatgaaa

SEQ ID NO: 744924 - DNA, 13 bp, C. elegans
ttttctaatggaa

SEQ ID NO: 744925 - DNA, 13 bp, C. elegans
ttttctaattgaa

SEQ ID NO: 744926 - DNA, 13 bp, C. elegans
ttttctaattgat

SEQ ID NO: 744927 - DNA, 13 bp, C. elegans
ttttctacaaaaa

SEQ ID NO: 744928 - DNA, 13 bp, C. elegans
ttttctacaaatt

SEQ ID NO: 744929 - DNA, 13 bp, C. elegans
ttttctacaagaa

SEQ ID NO: 744930 - DNA, 13 bp, C. elegans
ttttctacagaaa

SEQ ID NO: 744931 - DNA, 13 bp, C. elegans
ttttctacattca

SEQ ID NO: 744932 - DNA, 13 bp, C. elegans
ttttctaccaaaa

SEQ ID NO: 744933 - DNA, 13 bp, C. elegans
ttttctaccgttt

SEQ ID NO: 744934 - DNA, 13 bp, C. elegans
ttttctacctcac

SEQ ID NO: 744935 - DNA, 13 bp, C. elegans
ttttctactgatt

SEQ ID NO: 744936 - DNA, 13 bp, C. elegans
ttttctacttgaa

SEQ ID NO: 744937 - DNA, 13 bp, C. elegans
ttttctacttgct

SEQ ID NO: 744938 - DNA, 13 bp, C. elegans
ttttctagaaaaa

SEQ ID NO: 744939 - DNA, 13 bp, C. elegans
ttttctagaaact

SEQ ID NO: 744940 - DNA, 13 bp, C. elegans
ttttctagaatat

SEQ ID NO: 744941 - DNA, 13 bp, C. elegans
ttttctagaattc

SEQ ID NO: 744942 - DNA, 13 bp, C. elegans
ttttctagagatt

SEQ ID NO: 744943 - DNA, 13 bp, C. elegans
ttttctagattta

SEQ ID NO: 744944 - DNA, 13 bp, C. elegans
ttttctagcctca

SEQ ID NO: 744945 - DNA, 13 bp, C. elegans
ttttctaggccat

SEQ ID NO: 744946 - DNA, 13 bp, C. elegans
ttttctagttaat

SEQ ID NO: 744947 - DNA, 13 bp, C. elegans
ttttctagtttac

SEQ ID NO: 744948 - DNA, 13 bp, C. elegans
ttttctagtttca

SEQ ID NO: 744949 - DNA, 13 bp, C. elegans
ttttctataagat

SEQ ID NO: 744950 - DNA, 13 bp, C. elegans
ttttctatacaaa

SEQ ID NO: 744951 - DNA, 13 bp, C. elegans
ttttctatcaaaa

SEQ ID NO: 744952 - DNA, 13 bp, C. elegans
ttttctatcagtt

SEQ ID NO: 744953 - DNA, 13 bp, C. elegans
ttttctatctcaa

SEQ ID NO: 744954 - DNA, 13 bp, C. elegans
ttttctatcttgc

SEQ ID NO: 744955 - DNA, 13 bp, C. elegans
ttttctatgaaat

SEQ ID NO: 744956 - DNA, 13 bp, C. elegans
ttttctatgcaaa

SEQ ID NO: 744957 - DNA, 13 bp, C. elegans
ttttctatgtgaa

SEQ ID NO: 744958 - DNA, 13 bp, C. elegans
ttttctattcaaa

SEQ ID NO: 744959 - DNA, 13 bp, C. elegans
ttttctattccaa

SEQ ID NO: 744960 - DNA, 13 bp, C. elegans
ttttctattgaaa

SEQ ID NO: 744961 - DNA, 13 bp, C. elegans
ttttctattgatc

SEQ ID NO: 744962 - DNA, 13 bp, C. elegans
ttttctatttgaa

SEQ ID NO: 744963 - DNA, 13 bp, C. elegans
ttttctatttgac

SEQ ID NO: 744964 - DNA, 13 bp, C. elegans
ttttctcaaaaaa

SEQ ID NO: 744965 - DNA, 13 bp, C. elegans
ttttctcaaaatt

SEQ ID NO: 744966 - DNA, 13 bp, C. elegans
ttttctcaaactt

SEQ ID NO: 744967 - DNA, 13 bp, C. elegans
ttttctcaacatt

SEQ ID NO: 744968 - DNA, 13 bp, C. elegans
ttttctcaacttc

SEQ ID NO: 744969 - DNA, 13 bp, C. elegans
ttttctcaagctt

SEQ ID NO: 744970 - DNA, 13 bp, C. elegans
ttttctcaagtta

SEQ ID NO: 744971 - DNA, 13 bp, C. elegans
ttttctcaagttt

SEQ ID NO: 744972 - DNA, 13 bp, C. elegans
ttttctcaataat

SEQ ID NO: 744973 - DNA, 13 bp, C. elegans
ttttctcaatata

SEQ ID NO: 744974 - DNA, 13 bp, C. elegans
ttttctcaattaa

SEQ ID NO: 744975 - DNA, 13 bp, C. elegans
ttttctcacaaaa

SEQ ID NO: 744976 - DNA, 13 bp, C. elegans
ttttctcacaaac

SEQ ID NO: 744977 - DNA, 13 bp, C. elegans
ttttctcacaaat

SEQ ID NO: 744978 - DNA, 13 bp, C. elegans
ttttctcacacac

SEQ ID NO: 744979 - DNA, 13 bp, C. elegans
ttttctcaccaaa

SEQ ID NO: 744980 - DNA, 13 bp, C. elegans
ttttctcactgat

SEQ ID NO: 744981 - DNA, 13 bp, C. elegans
ttttctcagaaaa

SEQ ID NO: 744982 - DNA, 13 bp, C. elegans
ttttctcagaatt

SEQ ID NO: 744983 - DNA, 13 bp, C. elegans
ttttctcagttaa

SEQ ID NO: 744984 - DNA, 13 bp, C. elegans
ttttctcagttga

SEQ ID NO: 744985 - DNA, 13 bp, C. elegans
ttttctcataaaa

SEQ ID NO: 744986 - DNA, 13 bp, C. elegans
ttttctcatcaat

SEQ ID NO: 744987 - DNA, 13 bp, C. elegans
ttttctcatcgaa

SEQ ID NO: 744988 - DNA, 13 bp, C. elegans
ttttctcatgaaa

SEQ ID NO: 744989 - DNA, 13 bp, C. elegans
ttttctcatgatt

SEQ ID NO: 744990 - DNA, 13 bp, C. elegans
ttttctcattcac

SEQ ID NO: 744991 - DNA, 13 bp, C. elegans
ttttctcattgaa

SEQ ID NO: 744992 - DNA, 13 bp, C. elegans
ttttctcattgat

SEQ ID NO: 744993 - DNA, 13 bp, C. elegans
ttttctcattgtc

SEQ ID NO: 744994 - DNA, 13 bp, C. elegans
ttttctccaaaaa

SEQ ID NO: 744995 - DNA, 14 bp, C. elegans
ttttctccaaaatt

SEQ ID NO: 744996 - DNA, 13 bp, C. elegans
ttttctccaactt

SEQ ID NO: 744997 - DNA, 13 bp, C. elegans
ttttctccaatat

SEQ ID NO: 744998 - DNA, 13 bp, C. elegans
ttttctccacaat

SEQ ID NO: 744999 - DNA, 13 bp, C. elegans
ttttctccaccaa

SEQ ID NO: 745000 - DNA, 13 bp, C. elegans
ttttctccagatt

SEQ ID NO: 745001 - DNA, 13 bp, C. elegans
ttttctcccaaaa

SEQ ID NO: 745002 - DNA, 13 bp, C. elegans
ttttctcccgtgc

SEQ ID NO: 745003 - DNA, 13 bp, C. elegans
ttttctccgcaaa

SEQ ID NO: 745004 - DNA, 13 bp, C. elegans
ttttctccggaaa

SEQ ID NO: 745005 - DNA, 13 bp, C. elegans
ttttctccgtgag

SEQ ID NO: 745006 - DNA, 13 bp, C. elegans
ttttctcctaaaa

SEQ ID NO: 745007 - DNA, 13 bp, C. elegans
ttttctcgaagaa

SEQ ID NO: 745008 - DNA, 13 bp, C. elegans
ttttctcgaatat

SEQ ID NO: 745009 - DNA, 13 bp, C. elegans
ttttctcgaattc

SEQ ID NO: 745010 - DNA, 13 bp, C. elegans
ttttctcgacttt

SEQ ID NO: 745011 - DNA, 13 bp, C. elegans
ttttctcgatttg

SEQ ID NO: 745012 - DNA, 21 bp, C. elegans
ttttctcgcggacgagaaaac

SEQ ID NO: 745013 - DNA, 13 bp, C. elegans
ttttctcggattt

SEQ ID NO: 745014 - DNA, 13 bp, C. elegans
ttttctcgtactt

SEQ ID NO: 745015 - DNA, 13 bp, C. elegans
ttttctcgtcaaa

SEQ ID NO: 745016 - DNA, 13 bp, C. elegans
ttttctctaaaaa

SEQ ID NO: 745017 - DNA, 13 bp, C. elegans
ttttctctaaaac

SEQ ID NO: 745018 - DNA, 13 bp, C. elegans
ttttctctaaaat

SEQ ID NO: 745019 - DNA, 13 bp, C. elegans
ttttctctaaaca

SEQ ID NO: 745020 - DNA, 13 bp, C. elegans
ttttctctcaaaa

SEQ ID NO: 745021 - DNA, 14 bp, C. elegans
ttttctctcaaaat

SEQ ID NO: 745022 - DNA, 13 bp, C. elegans
ttttctctcagaa

SEQ ID NO: 745023 - DNA, 13 bp, C. elegans
ttttctctccaaa

SEQ ID NO: 745024 - DNA, 13 bp, C. elegans
ttttctctccaat

SEQ ID NO: 745025 - DNA, 13 bp, C. elegans
ttttctctcgaag

SEQ ID NO: 745026 - DNA, 13 bp, C. elegans
ttttctctctaaa

SEQ ID NO: 745027 - DNA, 13 bp, C. elegans
ttttctctctcaa

SEQ ID NO: 745028 - DNA, 13 bp, C. elegans
ttttctctctgaa

SEQ ID NO: 745029 - DNA, 13 bp, C. elegans
ttttctctgaaaa

SEQ ID NO: 745030 - DNA, 13 bp, C. elegans
ttttctctgaaat

SEQ ID NO: 745031 - DNA, 13 bp, C. elegans
ttttctctgaatt

SEQ ID NO: 745032 - DNA, 13 bp, C. elegans
ttttctctgcgtc

SEQ ID NO: 745033 - DNA, 13 bp, C. elegans
ttttctctggaaa

SEQ ID NO: 745034 - DNA, 13 bp, C. elegans
ttttctctgtgat

SEQ ID NO: 745035 - DNA, 13 bp, C. elegans
ttttctctgttca

SEQ ID NO: 745036 - DNA, 13 bp, C. elegans
ttttctcttcaaa

SEQ ID NO: 745037 - DNA, 13 bp, C. elegans
ttttctcttgaaa

SEQ ID NO: 745038 - DNA, 13 bp, C. elegans
ttttctgaaaaaa

SEQ ID NO: 745039 - DNA, 13 bp, C. elegans
ttttctgaaaaac

SEQ ID NO: 745040 - DNA, 13 bp, C. elegans
ttttctgaaaaat

SEQ ID NO: 745041 - DNA, 13 bp, C. elegans
ttttctgaaaacc

SEQ ID NO: 745042 - DNA, 13 bp, C. elegans
ttttctgaaaacg

SEQ ID NO: 745043 - DNA, 13 bp, C. elegans
ttttctgaaaaga

SEQ ID NO: 745044 - DNA, 13 bp, C. elegans
ttttctgaaaata

SEQ ID NO: 745045 - DNA, 13 bp, C. elegans
ttttctgaaaatt

SEQ ID NO: 745046 - DNA, 14 bp, C. elegans
ttttctgaaaattc

SEQ ID NO: 745047 - DNA, 13 bp, C. elegans
ttttctgaaacag

SEQ ID NO: 745048 - DNA, 13 bp, C. elegans
ttttctgaaacta

SEQ ID NO: 745049 - DNA, 13 bp, C. elegans
ttttctgaaactg

SEQ ID NO: 745050 - DNA, 13 bp, C. elegans
ttttctgaaaggg

SEQ ID NO: 745051 - DNA, 13 bp, C. elegans
ttttctgaaataa

SEQ ID NO: 745052 - DNA, 13 bp, C. elegans
ttttctgaaatac

SEQ ID NO: 745053 - DNA, 13 bp, C. elegans
ttttctgaaatcc

SEQ ID NO: 745054 - DNA, 13 bp, C. elegans
ttttctgaaatcg

SEQ ID NO: 745055 - DNA, 13 bp, C. elegans
ttttctgaaattg

SEQ ID NO: 745056 - DNA, 14 bp, C. elegans
ttttctgaaatttc

SEQ ID NO: 745057 - DNA, 13 bp, C. elegans
ttttctgaacaat

SEQ ID NO: 745058 - DNA, 13 bp, C. elegans
ttttctgaacatt

SEQ ID NO: 745059 - DNA, 13 bp, C. elegans
ttttctgaaccaa

SEQ ID NO: 745060 - DNA, 13 bp, C. elegans
ttttctgaacttt

SEQ ID NO: 745061 - DNA, 13 bp, C. elegans
ttttctgaagctt

SEQ ID NO: 745062 - DNA, 13 bp, C. elegans
ttttctgaataaa

SEQ ID NO: 745063 - DNA, 13 bp, C. elegans
ttttctgaatact

SEQ ID NO: 745064 - DNA, 13 bp, C. elegans
ttttctgaatatt

SEQ ID NO: 745065 - DNA, 13 bp, C. elegans
ttttctgaatcaa

SEQ ID NO: 745066 - DNA, 13 bp, C. elegans
ttttctgaatttc

SEQ ID NO: 745067 - DNA, 13 bp, C. elegans
ttttctgacaaag

SEQ ID NO: 745068 - DNA, 13 bp, C. elegans
ttttctgacaaat

SEQ ID NO: 745069 - DNA, 13 bp, C. elegans
ttttctgacaatt

SEQ ID NO: 745070 - DNA, 13 bp, C. elegans
ttttctgacagtt

SEQ ID NO: 745071 - DNA, 13 bp, C. elegans
ttttctgacattt

SEQ ID NO: 745072 - DNA, 13 bp, C. elegans
ttttctgactgat

SEQ ID NO: 745073 - DNA, 13 bp, C. elegans
ttttctgactttc

SEQ ID NO: 745074 - DNA, 13 bp, C. elegans
ttttctgagaaaa

SEQ ID NO: 745075 - DNA, 13 bp, C. elegans
ttttctgataaaa

SEQ ID NO: 745076 - DNA, 13 bp, C. elegans
ttttctgataaat

SEQ ID NO: 745077 - DNA, 13 bp, C. elegans
ttttctgatagtt

SEQ ID NO: 745078 - DNA, 13 bp, C. elegans
ttttctgatcaaa

SEQ ID NO: 745079 - DNA, 13 bp, C. elegans
ttttctgatcaat

SEQ ID NO: 745080 - DNA, 13 bp, C. elegans
ttttctgatgaaa

SEQ ID NO: 745081 - DNA, 13 bp, C. elegans
ttttctgattcca

SEQ ID NO: 745082 - DNA, 13 bp, C. elegans
ttttctgattctg

SEQ ID NO: 745083 - DNA, 13 bp, C. elegans
ttttctgatttca

SEQ ID NO: 745084 - DNA, 13 bp, C. elegans
ttttctgcaaaaa

SEQ ID NO: 745085 - DNA, 13 bp, C. elegans
ttttctgcaaaac

SEQ ID NO: 745086 - DNA, 13 bp, C. elegans
ttttctgcaaaat

SEQ ID NO: 745087 - DNA, 13 bp, C. elegans
ttttctgcaactt

SEQ ID NO: 745088 - DNA, 13 bp, C. elegans
ttttctgcaattt

SEQ ID NO: 745089 - DNA, 13 bp, C. elegans
ttttctgcataaa

SEQ ID NO: 745090 - DNA, 13 bp, C. elegans
ttttctgccaaaa

SEQ ID NO: 745091 - DNA, 13 bp, C. elegans
ttttctgcgattt

SEQ ID NO: 745092 - DNA, 13 bp, C. elegans
ttttctgctgaaa

SEQ ID NO: 745093 - DNA, 13 bp, C. elegans
ttttctgcttgaa

SEQ ID NO: 745094 - DNA, 13 bp, C. elegans
ttttctggaaaaa

SEQ ID NO: 745095 - DNA, 13 bp, C. elegans
ttttctggaaaac

SEQ ID NO: 745096 - DNA, 13 bp, C. elegans
ttttctggaaaat

SEQ ID NO: 745097 - DNA, 13 bp, C. elegans
ttttctggaactt

SEQ ID NO: 745098 - DNA, 13 bp, C. elegans
ttttctggaagat

SEQ ID NO: 745099 - DNA, 13 bp, C. elegans
ttttctggaattt

SEQ ID NO: 745100 - DNA, 13 bp, C. elegans
ttttctggagaaa

SEQ ID NO: 745101 - DNA, 13 bp, C. elegans
ttttctggaggaa

SEQ ID NO: 745102 - DNA, 13 bp, C. elegans
ttttctggatgaa

SEQ ID NO: 745103 - DNA, 13 bp, C. elegans
ttttctggatttc

SEQ ID NO: 745104 - DNA, 13 bp, C. elegans
ttttctggcattt

SEQ ID NO: 745105 - DNA, 13 bp, C. elegans
ttttctggcttaa

SEQ ID NO: 745106 - DNA, 13 bp, C. elegans
ttttctgggattt

SEQ ID NO: 745107 - DNA, 13 bp, C. elegans
ttttctgggcaaa

SEQ ID NO: 745108 - DNA, 13 bp, C. elegans
ttttctgtaaaaa

SEQ ID NO: 745109 - DNA, 13 bp, C. elegans
ttttctgtaactg

SEQ ID NO: 745110 - DNA, 13 bp, C. elegans
ttttctgtaagaa

SEQ ID NO: 745111 - DNA, 13 bp, C. elegans
ttttctgtaataa

SEQ ID NO: 745112 - DNA, 13 bp, C. elegans
ttttctgtaatat

SEQ ID NO: 745113 - DNA, 13 bp, C. elegans
ttttctgtaatct

SEQ ID NO: 745114 - DNA, 13 bp, C. elegans
ttttctgtagaaa

SEQ ID NO: 745115 - DNA, 13 bp, C. elegans
ttttctgtagaac

SEQ ID NO: 745116 - DNA, 13 bp, C. elegans
ttttctgtagata

SEQ ID NO: 745117 - DNA, 13 bp, C. elegans
ttttctgtataaa

SEQ ID NO: 745118 - DNA, 13 bp, C. elegans
ttttctgtgaaag

SEQ ID NO: 745119 - DNA, 13 bp, C. elegans
ttttctgtgatat

SEQ ID NO: 745120 - DNA, 13 bp, C. elegans
ttttctgttaaaa

SEQ ID NO: 745121 - DNA, 13 bp, C. elegans
ttttctgttaaat

SEQ ID NO: 745122 - DNA, 13 bp, C. elegans
ttttctgttccta

SEQ ID NO: 745123 - DNA, 13 bp, C. elegans
ttttctgtttcaa

SEQ ID NO: 745124 - DNA, 13 bp, C. elegans
ttttctgtttcca

SEQ ID NO: 745125 - DNA, 13 bp, C. elegans
ttttctgtttgaa

SEQ ID NO: 745126 - DNA, 13 bp, C. elegans
ttttcttaaaact

SEQ ID NO: 745127 - DNA, 13 bp, C. elegans
ttttcttaaaatc

SEQ ID NO: 745128 - DNA, 13 bp, C. elegans
ttttcttaaacat

SEQ ID NO: 745129 - DNA, 13 bp, C. elegans
ttttcttaaatgc

SEQ ID NO: 745130 - DNA, 13 bp, C. elegans
ttttcttacaaaa

SEQ ID NO: 745131 - DNA, 13 bp, C. elegans
ttttcttactgat

SEQ ID NO: 745132 - DNA, 13 bp, C. elegans
ttttcttagaaat

SEQ ID NO: 745133 - DNA, 13 bp, C. elegans
ttttcttatcagt

SEQ ID NO: 745134 - DNA, 13 bp, C. elegans
ttttcttatcgaa

SEQ ID NO: 745135 - DNA, 13 bp, C. elegans
ttttcttatgata

SEQ ID NO: 745136 - DNA, 13 bp, C. elegans
ttttcttcaaaac

SEQ ID NO: 745137 - DNA, 13 bp, C. elegans
ttttcttcaaata

SEQ ID NO: 745138 - DNA, 13 bp, C. elegans
ttttcttcaaatc

SEQ ID NO: 745139 - DNA, 13 bp, C. elegans
ttttcttcaagaa

SEQ ID NO: 745140 - DNA, 13 bp, C. elegans
ttttcttcaagtt

SEQ ID NO: 745141 - DNA, 13 bp, C. elegans
ttttcttcacgat

SEQ ID NO: 745142 - DNA, 13 bp, C. elegans
ttttcttcagaaa

SEQ ID NO: 745143 - DNA, 13 bp, C. elegans
ttttcttcagcaa

SEQ ID NO: 745144 - DNA, 13 bp, C. elegans
ttttcttcaggaa

SEQ ID NO: 745145 - DNA, 13 bp, C. elegans
ttttcttcataaa

SEQ ID NO: 745146 - DNA, 13 bp, C. elegans
ttttcttccaaaa

SEQ ID NO: 745147 - DNA, 13 bp, C. elegans
ttttcttcccatg

SEQ ID NO: 745148 - DNA, 13 bp, C. elegans
ttttcttccgatt

SEQ ID NO: 745149 - DNA, 13 bp, C. elegans
ttttcttcgaaaa

SEQ ID NO: 745150 - DNA, 13 bp, C. elegans
ttttcttcgaaat

SEQ ID NO: 745151 - DNA, 13 bp, C. elegans
ttttcttcgagaa

SEQ ID NO: 745152 - DNA, 13 bp, C. elegans
ttttcttcgagtt

SEQ ID NO: 745153 - DNA, 13 bp, C. elegans
ttttcttcggaaa

SEQ ID NO: 745154 - DNA, 13 bp, C. elegans
ttttcttctaaaa

SEQ ID NO: 745155 - DNA, 13 bp, C. elegans
ttttcttctcaaa

SEQ ID NO: 745156 - DNA, 13 bp, C. elegans
ttttcttctcgaa

SEQ ID NO: 745157 - DNA, 13 bp, C. elegans
ttttcttcttcga

SEQ ID NO: 745158 - DNA, 13 bp, C. elegans
ttttcttgaaaaa

SEQ ID NO: 745159 - DNA, 13 bp, C. elegans
ttttcttgaaaat

SEQ ID NO: 745160 - DNA, 13 bp, C. elegans
ttttcttgaacaa

SEQ ID NO: 745161 - DNA, 13 bp, C. elegans
ttttcttgaagaa

SEQ ID NO: 745162 - DNA, 13 bp, C. elegans
ttttcttgaatat

SEQ ID NO: 745163 - DNA, 13 bp, C. elegans
ttttcttgatgaa

SEQ ID NO: 745164 - DNA, 13 bp, C. elegans
ttttcttgcaaaa

SEQ ID NO: 745165 - DNA, 13 bp, C. elegans
ttttcttgcaatt

SEQ ID NO: 745166 - DNA, 13 bp, C. elegans
ttttcttgcactt

SEQ ID NO: 745167 - DNA, 13 bp, C. elegans
ttttcttgccaaa

SEQ ID NO: 745168 - DNA, 13 bp, C. elegans
ttttcttgccatt

SEQ ID NO: 745169 - DNA, 13 bp, C. elegans
ttttcttgcgaaa

SEQ ID NO: 745170 - DNA, 13 bp, C. elegans
ttttcttgcttca

SEQ ID NO: 745171 - DNA, 13 bp, C. elegans
ttttcttggaaaa

SEQ ID NO: 745172 - DNA, 13 bp, C. elegans
ttttcttggaaac

SEQ ID NO: 745173 - DNA, 13 bp, C. elegans
ttttcttggaaat

SEQ ID NO: 745174 - DNA, 13 bp, C. elegans
ttttcttgtaaaa

SEQ ID NO: 745175 - DNA, 13 bp, C. elegans
ttttcttgtcgaa

SEQ ID NO: 745176 - DNA, 13 bp, C. elegans
ttttcttgttaga

SEQ ID NO: 745177 - DNA, 13 bp, C. elegans
ttttcttgttcaa

SEQ ID NO: 745178 - DNA, 13 bp, C. elegans
ttttcttgttcca

SEQ ID NO: 745179 - DNA, 13 bp, C. elegans
ttttcttgttgaa

SEQ ID NO: 745180 - DNA, 13 bp, C. elegans
ttttctttcaaaa

SEQ ID NO: 745181 - DNA, 14 bp, C. elegans
ttttctttcaaaat

SEQ ID NO: 745182 - DNA, 13 bp, C. elegans
ttttctttcaaac

SEQ ID NO: 745183 - DNA, 13 bp, C. elegans
ttttctttcaaca

SEQ ID NO: 745184 - DNA, 13 bp, C. elegans
ttttctttcagta

SEQ ID NO: 745185 - DNA, 13 bp, C. elegans
ttttctttccaga

SEQ ID NO: 745186 - DNA, 13 bp, C. elegans
ttttctttgaaaa

SEQ ID NO: 745187 - DNA, 13 bp, C. elegans
ttttctttgagaa

SEQ ID NO: 745188 - DNA, 13 bp, C. elegans
ttttctttggaat

SEQ ID NO: 745189 - DNA, 13 bp, C. elegans
ttttcttttgcaa

SEQ ID NO: 745190 - DNA, 13 bp, C. elegans
ttttgaaaaaact

SEQ ID NO: 745191 - DNA, 13 bp, C. elegans
ttttgaaaaaaga

SEQ ID NO: 745192 - DNA, 13 bp, C. elegans
ttttgaaaaaccg

SEQ ID NO: 745193 - DNA, 13 bp, C. elegans
ttttgaaaaagaa

SEQ ID NO: 745194 - DNA, 13 bp, C. elegans
ttttgaaaaatag

SEQ ID NO: 745195 - DNA, 15 bp, C. elegans
ttttgaaaaatcgaa

SEQ ID NO: 745196 - DNA, 13 bp, C. elegans
ttttgaaaaatct

SEQ ID NO: 745197 - DNA, 14 bp, C. elegans
ttttgaaaaattct

SEQ ID NO: 745198 - DNA, 13 bp, C. elegans
ttttgaaaaattg

SEQ ID NO: 745199 - DNA, 13 bp, C. elegans
ttttgaaaacatt

SEQ ID NO: 745200 - DNA, 13 bp, C. elegans
ttttgaaaacgat

SEQ ID NO: 745201 - DNA, 13 bp, C. elegans
ttttgaaaacgtc

SEQ ID NO: 745202 - DNA, 13 bp, C. elegans
ttttgaaaactat

SEQ ID NO: 745203 - DNA, 13 bp, C. elegans
ttttgaaaactgg

SEQ ID NO: 745204 - DNA, 13 bp, C. elegans
ttttgaaaacttg

SEQ ID NO: 745205 - DNA, 13 bp, C. elegans
ttttgaaaagaaa

SEQ ID NO: 745206 - DNA, 13 bp, C. elegans
ttttgaaaagagc

SEQ ID NO: 745207 - DNA, 13 bp, C. elegans
ttttgaaaagatt

SEQ ID NO: 745208 - DNA, 13 bp, C. elegans
ttttgaaaagtaa

SEQ ID NO: 745209 - DNA, 13 bp, C. elegans
ttttgaaaagtat

SEQ ID NO: 745210 - DNA, 13 bp, C. elegans
ttttgaaaagtgt

SEQ ID NO: 745211 - DNA, 13 bp, C. elegans
ttttgaaaataac

SEQ ID NO: 745212 - DNA, 13 bp, C. elegans
ttttgaaaataga

SEQ ID NO: 745213 - DNA, 13 bp, C. elegans
ttttgaaaatatc

SEQ ID NO: 745214 - DNA, 13 bp, C. elegans
ttttgaaaatcac

SEQ ID NO: 745215 - DNA, 13 bp, C. elegans
ttttgaaaatctc

SEQ ID NO: 745216 - DNA, 13 bp, C. elegans
ttttgaaaatgaa

SEQ ID NO: 745217 - DNA, 14 bp, C. elegans
ttttgaaaatgaaa

SEQ ID NO: 745218 - DNA, 14 bp, C. elegans
ttttgaaaatggaa

SEQ ID NO: 745219 - DNA, 14 bp, C. elegans
ttttgaaaatgtct

SEQ ID NO: 745220 - DNA, 13 bp, C. elegans
ttttgaaaatgtt

SEQ ID NO: 745221 - DNA, 13 bp, C. elegans
ttttgaaaattac

SEQ ID NO: 745222 - DNA, 13 bp, C. elegans
ttttgaaaattca

SEQ ID NO: 745223 - DNA, 13 bp, C. elegans
ttttgaaaattga

SEQ ID NO: 745224 - DNA, 13 bp, C. elegans
ttttgaaaattgc

SEQ ID NO: 745225 - DNA, 13 bp, C. elegans
ttttgaaaattgt

SEQ ID NO: 745226 - DNA, 13 bp, C. elegans
ttttgaaaatttc

SEQ ID NO: 745227 - DNA, 13 bp, C. elegans
ttttgaaaatttg

SEQ ID NO: 745228 - DNA, 13 bp, C. elegans
ttttgaaacaaaa

SEQ ID NO: 745229 - DNA, 13 bp, C. elegans
ttttgaaacaaca

SEQ ID NO: 745230 - DNA, 13 bp, C. elegans
ttttgaaacaatt

SEQ ID NO: 745231 - DNA, 13 bp, C. elegans
ttttgaaacatta

SEQ ID NO: 745232 - DNA, 13 bp, C. elegans
ttttgaaacattg

SEQ ID NO: 745233 - DNA, 13 bp, C. elegans
ttttgaaaccaac

SEQ ID NO: 745234 - DNA, 13 bp, C. elegans
ttttgaaacgttt

SEQ ID NO: 745235 - DNA, 13 bp, C. elegans
ttttgaaactaca

SEQ ID NO: 745236 - DNA, 13 bp, C. elegans
ttttgaaactacc

SEQ ID NO: 745237 - DNA, 13 bp, C. elegans
ttttgaaactaga

SEQ ID NO: 745238 - DNA, 13 bp, C. elegans
ttttgaaactatt

SEQ ID NO: 745239 - DNA, 13 bp, C. elegans
ttttgaaactcct

SEQ ID NO: 745240 - DNA, 13 bp, C. elegans
ttttgaaactctt

SEQ ID NO: 745241 - DNA, 13 bp, C. elegans
ttttgaaactgct

SEQ ID NO: 745242 - DNA, 13 bp, C. elegans
ttttgaaacttca

SEQ ID NO: 745243 - DNA, 13 bp, C. elegans
ttttgaaacttgt

SEQ ID NO: 745244 - DNA, 13 bp, C. elegans
ttttgaaacttta

SEQ ID NO: 745245 - DNA, 13 bp, C. elegans
ttttgaaactttg

SEQ ID NO: 745246 - DNA, 13 bp, C. elegans
ttttgaaagaaaa

SEQ ID NO: 745247 - DNA, 13 bp, C. elegans
ttttgaaagaaag

SEQ ID NO: 745248 - DNA, 13 bp, C. elegans
ttttgaaagaaat

SEQ ID NO: 745249 - DNA, 13 bp, C. elegans
ttttgaaagaaca

SEQ ID NO: 745250 - DNA, 13 bp, C. elegans
ttttgaaagaatt

SEQ ID NO: 745251 - DNA, 13 bp, C. elegans
ttttgaaagagaa

SEQ ID NO: 745252 - DNA, 13 bp, C. elegans
ttttgaaagataa

SEQ ID NO: 745253 - DNA, 13 bp, C. elegans
ttttgaaagatat

SEQ ID NO: 745254 - DNA, 13 bp, C. elegans
ttttgaaagatta

SEQ ID NO: 745255 - DNA, 13 bp, C. elegans
ttttgaaagattc

SEQ ID NO: 745256 - DNA, 13 bp, C. elegans
ttttgaaagattt

SEQ ID NO: 745257 - DNA, 13 bp, C. elegans
ttttgaaagctga

SEQ ID NO: 745258 - DNA, 13 bp, C. elegans
ttttgaaagcttt

SEQ ID NO: 745259 - DNA, 13 bp, C. elegans
ttttgaaaggaaa

SEQ ID NO: 745260 - DNA, 13 bp, C. elegans
ttttgaaaggttt

SEQ ID NO: 745261 - DNA, 13 bp, C. elegans
ttttgaaagtata

SEQ ID NO: 745262 - DNA, 13 bp, C. elegans
ttttgaaagtcta

SEQ ID NO: 745263 - DNA, 13 bp, C. elegans
ttttgaaagtggt

SEQ ID NO: 745264 - DNA, 13 bp, C. elegans
ttttgaaagtgtt

SEQ ID NO: 745265 - DNA, 13 bp, C. elegans
ttttgaaagttgt

SEQ ID NO: 745266 - DNA, 13 bp, C. elegans
ttttgaaagtttc

SEQ ID NO: 745267 - DNA, 13 bp, C. elegans
ttttgaaataaga

SEQ ID NO: 745268 - DNA, 13 bp, C. elegans
ttttgaaatacta

SEQ ID NO: 745269 - DNA, 13 bp, C. elegans
ttttgaaatagtt

SEQ ID NO: 745270 - DNA, 13 bp, C. elegans
ttttgaaatattc

SEQ ID NO: 745271 - DNA, 13 bp, C. elegans
ttttgaaatcaaa

SEQ ID NO: 745272 - DNA, 13 bp, C. elegans
ttttgaaatcaat

SEQ ID NO: 745273 - DNA, 13 bp, C. elegans
ttttgaaatcacc

SEQ ID NO: 745274 - DNA, 13 bp, C. elegans
ttttgaaatcatc

SEQ ID NO: 745275 - DNA, 13 bp, C. elegans
ttttgaaatcgaa

SEQ ID NO: 745276 - DNA, 13 bp, C. elegans
ttttgaaatctaa

SEQ ID NO: 745277 - DNA, 13 bp, C. elegans
ttttgaaatgaat

SEQ ID NO: 745278 - DNA, 13 bp, C. elegans
ttttgaaatggaa

SEQ ID NO: 745279 - DNA, 13 bp, C. elegans
ttttgaaatgtat

SEQ ID NO: 745280 - DNA, 13 bp, C. elegans
ttttgaaatgtct

SEQ ID NO: 745281 - DNA, 13 bp, C. elegans
ttttgaaatgttc

SEQ ID NO: 745282 - DNA, 13 bp, C. elegans
ttttgaaattagc

SEQ ID NO: 745283 - DNA, 13 bp, C. elegans
ttttgaaattcag

SEQ ID NO: 745284 - DNA, 13 bp, C. elegans
ttttgaaattcgg

SEQ ID NO: 745285 - DNA, 13 bp, C. elegans
ttttgaaattcta

SEQ ID NO: 745286 - DNA, 14 bp, C. elegans
ttttgaaattctca

SEQ ID NO: 745287 - DNA, 13 bp, C. elegans
ttttgaaattgag

SEQ ID NO: 745288 - DNA, 13 bp, C. elegans
ttttgaaattgta

SEQ ID NO: 745289 - DNA, 14 bp, C. elegans
ttttgaaatttcaa

SEQ ID NO: 745290 - DNA, 14 bp, C. elegans
ttttgaaatttcct

SEQ ID NO: 745291 - DNA, 13 bp, C. elegans
ttttgaaatttgc

SEQ ID NO: 745292 - DNA, 13 bp, C. elegans
ttttgaaatttgg

SEQ ID NO: 745293 - DNA, 13 bp, C. elegans
ttttgaacaaaaa

SEQ ID NO: 745294 - DNA, 13 bp, C. elegans
ttttgaacaaaat

SEQ ID NO: 745295 - DNA, 13 bp, C. elegans
ttttgaacaacaa

SEQ ID NO: 745296 - DNA, 13 bp, C. elegans
ttttgaacaagaa

SEQ ID NO: 745297 - DNA, 13 bp, C. elegans
ttttgaacacatt

SEQ ID NO: 745298 - DNA, 13 bp, C. elegans
ttttgaacagaaa

SEQ ID NO: 745299 - DNA, 13 bp, C. elegans
ttttgaacataaa

SEQ ID NO: 745300 - DNA, 13 bp, C. elegans
ttttgaacataag

SEQ ID NO: 745301 - DNA, 13 bp, C. elegans
ttttgaacataga

SEQ ID NO: 745302 - DNA, 13 bp, C. elegans
ttttgaacattat

SEQ ID NO: 745303 - DNA, 13 bp, C. elegans
ttttgaacatttc

SEQ ID NO: 745304 - DNA, 13 bp, C. elegans
ttttgaacatttt

SEQ ID NO: 745305 - DNA, 13 bp, C. elegans
ttttgaacgaaat

SEQ ID NO: 745306 - DNA, 13 bp, C. elegans
ttttgaacgaatt

SEQ ID NO: 745307 - DNA, 13 bp, C. elegans
ttttgaacgagaa

SEQ ID NO: 745308 - DNA, 13 bp, C. elegans
ttttgaacgatta

SEQ ID NO: 745309 - DNA, 13 bp, C. elegans
ttttgaacgattt

SEQ ID NO: 745310 - DNA, 13 bp, C. elegans
ttttgaacgtaaa

SEQ ID NO: 745311 - DNA, 13 bp, C. elegans
ttttgaacgtttt

SEQ ID NO: 745312 - DNA, 13 bp, C. elegans
ttttgaactacaa

SEQ ID NO: 745313 - DNA, 13 bp, C. elegans
ttttgaactatca

SEQ ID NO: 745314 - DNA, 13 bp, C. elegans
ttttgaactattt

SEQ ID NO: 745315 - DNA, 13 bp, C. elegans
ttttgaactcaaa

SEQ ID NO: 745316 - DNA, 13 bp, C. elegans
ttttgaactctca

SEQ ID NO: 745317 - DNA, 13 bp, C. elegans
ttttgaactgaaa

SEQ ID NO: 745318 - DNA, 13 bp, C. elegans
ttttgaactgttt

SEQ ID NO: 745319 - DNA, 13 bp, C. elegans
ttttgaacttgaa

SEQ ID NO: 745320 - DNA, 13 bp, C. elegans
ttttgaactttcg

SEQ ID NO: 745321 - DNA, 13 bp, C. elegans
ttttgaacttttc

SEQ ID NO: 745322 - DNA, 13 bp, C. elegans
ttttgaagaaaaa

SEQ ID NO: 745323 - DNA, 13 bp, C. elegans
ttttgaagaaaag

SEQ ID NO: 745324 - DNA, 13 bp, C. elegans
ttttgaagaaatt

SEQ ID NO: 745325 - DNA, 13 bp, C. elegans
ttttgaagaacaa

SEQ ID NO: 745326 - DNA, 13 bp, C. elegans
ttttgaagaactt

SEQ ID NO: 745327 - DNA, 13 bp, C. elegans
ttttgaagaagaa

SEQ ID NO: 745328 - DNA, 13 bp, C. elegans
ttttgaagaagct

SEQ ID NO: 745329 - DNA, 13 bp, C. elegans
ttttgaagaagtt

SEQ ID NO: 745330 - DNA, 13 bp, C. elegans
ttttgaagaatat

SEQ ID NO: 745331 - DNA, 13 bp, C. elegans
ttttgaagaatta

SEQ ID NO: 745332 - DNA, 13 bp, C. elegans
ttttgaagaattt

SEQ ID NO: 745333 - DNA, 13 bp, C. elegans
ttttgaagacttc

SEQ ID NO: 745334 - DNA, 13 bp, C. elegans
ttttgaagagaat

SEQ ID NO: 745335 - DNA, 13 bp, C. elegans
ttttgaagagctc

SEQ ID NO: 745336 - DNA, 13 bp, C. elegans
ttttgaagagttt

SEQ ID NO: 745337 - DNA, 13 bp, C. elegans
ttttgaagatatt

SEQ ID NO: 745338 - DNA, 13 bp, C. elegans
ttttgaagatgga

SEQ ID NO: 745339 - DNA, 13 bp, C. elegans
ttttgaagattaa

SEQ ID NO: 745340 - DNA, 13 bp, C. elegans
ttttgaagattat

SEQ ID NO: 745341 - DNA, 13 bp, C. elegans
ttttgaagcaaaa

SEQ ID NO: 745342 - DNA, 13 bp, C. elegans
ttttgaagcaata

SEQ ID NO: 745343 - DNA, 13 bp, C. elegans
ttttgaagcagtt

SEQ ID NO: 745344 - DNA, 13 bp, C. elegans
ttttgaagcattt

SEQ ID NO: 745345 - DNA, 13 bp, C. elegans
ttttgaagcgaaa

SEQ ID NO: 745346 - DNA, 13 bp, C. elegans
ttttgaagcttca

SEQ ID NO: 745347 - DNA, 13 bp, C. elegans
ttttgaagcttta

SEQ ID NO: 745348 - DNA, 13 bp, C. elegans
ttttgaaggaaaa

SEQ ID NO: 745349 - DNA, 13 bp, C. elegans
ttttgaaggaata

SEQ ID NO: 745350 - DNA, 13 bp, C. elegans
ttttgaaggatat

SEQ ID NO: 745351 - DNA, 13 bp, C. elegans
ttttgaaggattt

SEQ ID NO: 745352 - DNA, 13 bp, C. elegans
ttttgaaggcaaa

SEQ ID NO: 745353 - DNA, 13 bp, C. elegans
ttttgaagggata

SEQ ID NO: 745354 - DNA, 13 bp, C. elegans
ttttgaagtaaaa

SEQ ID NO: 745355 - DNA, 13 bp, C. elegans
ttttgaagtcgac

SEQ ID NO: 745356 - DNA, 13 bp, C. elegans
ttttgaagtctga

SEQ ID NO: 745357 - DNA, 13 bp, C. elegans
ttttgaagtgatt

SEQ ID NO: 745358 - DNA, 13 bp, C. elegans
ttttgaagttaaa

SEQ ID NO: 745359 - DNA, 13 bp, C. elegans
ttttgaagttgaa

SEQ ID NO: 745360 - DNA, 13 bp, C. elegans
ttttgaataaagt

SEQ ID NO: 745361 - DNA, 13 bp, C. elegans
ttttgaataacaa

SEQ ID NO: 745362 - DNA, 13 bp, C. elegans
ttttgaataagtt

SEQ ID NO: 745363 - DNA, 13 bp, C. elegans
ttttgaataattg

SEQ ID NO: 745364 - DNA, 13 bp, C. elegans
ttttgaatacttt

SEQ ID NO: 745365 - DNA, 13 bp, C. elegans
ttttgaatagaaa

SEQ ID NO: 745366 - DNA, 13 bp, C. elegans
ttttgaatagata

SEQ ID NO: 745367 - DNA, 13 bp, C. elegans
ttttgaatagatt

SEQ ID NO: 745368 - DNA, 13 bp, C. elegans
ttttgaatataca

SEQ ID NO: 745369 - DNA, 13 bp, C. elegans
ttttgaatatcta

SEQ ID NO: 745370 - DNA, 13 bp, C. elegans
ttttgaatattca

SEQ ID NO: 745371 - DNA, 13 bp, C. elegans
ttttgaatatttc

SEQ ID NO: 745372 - DNA, 13 bp, C. elegans
ttttgaatcaaaa

SEQ ID NO: 745373 - DNA, 13 bp, C. elegans
ttttgaatcaaac

SEQ ID NO: 745374 - DNA, 13 bp, C. elegans
ttttgaatcaata

SEQ ID NO: 745375 - DNA, 13 bp, C. elegans
ttttgaatcaatc

SEQ ID NO: 745376 - DNA, 13 bp, C. elegans
ttttgaatcatta

SEQ ID NO: 745377 - DNA, 13 bp, C. elegans
ttttgaatcattt

SEQ ID NO: 745378 - DNA, 13 bp, C. elegans
ttttgaatcgcca

SEQ ID NO: 745379 - DNA, 13 bp, C. elegans
ttttgaatcttaa

SEQ ID NO: 745380 - DNA, 13 bp, C. elegans
ttttgaatcttga

SEQ ID NO: 745381 - DNA, 13 bp, C. elegans
ttttgaatgaaaa

SEQ ID NO: 745382 - DNA, 13 bp, C. elegans
ttttgaattacaa

SEQ ID NO: 745383 - DNA, 13 bp, C. elegans
ttttgaattactg

SEQ ID NO: 745384 - DNA, 13 bp, C. elegans
ttttgaattagaa

SEQ ID NO: 745385 - DNA, 13 bp, C. elegans
ttttgaattccaa

SEQ ID NO: 745386 - DNA, 13 bp, C. elegans
ttttgaattccat

SEQ ID NO: 745387 - DNA, 13 bp, C. elegans
ttttgaattcccg

SEQ ID NO: 745388 - DNA, 13 bp, C. elegans
ttttgaattcttc

SEQ ID NO: 745389 - DNA, 13 bp, C. elegans
ttttgaattgaaa

SEQ ID NO: 745390 - DNA, 13 bp, C. elegans
ttttgaattgaac

SEQ ID NO: 745391 - DNA, 13 bp, C. elegans
ttttgaattggaa

SEQ ID NO: 745392 - DNA, 13 bp, C. elegans
ttttgaattgtga

SEQ ID NO: 745393 - DNA, 13 bp, C. elegans
ttttgaatttaca

SEQ ID NO: 745394 - DNA, 13 bp, C. elegans
ttttgaatttatc

SEQ ID NO: 745395 - DNA, 13 bp, C. elegans
ttttgaatttcgt

SEQ ID NO: 745396 - DNA, 13 bp, C. elegans
ttttgaatttgtc

SEQ ID NO: 745397 - DNA, 14 bp, C. elegans
ttttgaattttcgc

SEQ ID NO: 745398 - DNA, 13 bp, C. elegans
ttttgacaaaaaa

SEQ ID NO: 745399 - DNA, 13 bp, C. elegans
ttttgacaaaaca

SEQ ID NO: 745400 - DNA, 13 bp, C. elegans
ttttgacaaaata

SEQ ID NO: 745401 - DNA, 13 bp, C. elegans
ttttgacaaacaa

SEQ ID NO: 745402 - DNA, 13 bp, C. elegans
ttttgacaaagaa

SEQ ID NO: 745403 - DNA, 13 bp, C. elegans
ttttgacaaatat

SEQ ID NO: 745404 - DNA, 13 bp, C. elegans
ttttgacaaatgt

SEQ ID NO: 745405 - DNA, 13 bp, C. elegans
ttttgacaaattg

SEQ ID NO: 745406 - DNA, 13 bp, C. elegans
ttttgacaaattt

SEQ ID NO: 745407 - DNA, 13 bp, C. elegans
ttttgacaagttt

SEQ ID NO: 745408 - DNA, 13 bp, C. elegans
ttttgacacaatt

SEQ ID NO: 745409 - DNA, 13 bp, C. elegans
ttttgacactttt

SEQ ID NO: 745410 - DNA, 13 bp, C. elegans
ttttgacagtaaa

SEQ ID NO: 745411 - DNA, 13 bp, C. elegans
ttttgacataaat

SEQ ID NO: 745412 - DNA, 13 bp, C. elegans
ttttgacattctt

SEQ ID NO: 745413 - DNA, 13 bp, C. elegans
ttttgacatttac

SEQ ID NO: 745414 - DNA, 13 bp, C. elegans
ttttgaccaaaac

SEQ ID NO: 745415 - DNA, 13 bp, C. elegans
ttttgaccgaaaa

SEQ ID NO: 745416 - DNA, 13 bp, C. elegans
ttttgacgaattt

SEQ ID NO: 745417 - DNA, 13 bp, C. elegans
ttttgacgagaaa

SEQ ID NO: 745418 - DNA, 13 bp, C. elegans
ttttgacggaaaa

SEQ ID NO: 745419 - DNA, 13 bp, C. elegans
ttttgacgggtta

SEQ ID NO: 745420 - DNA, 13 bp, C. elegans
ttttgacgggttt

SEQ ID NO: 745421 - DNA, 13 bp, C. elegans
ttttgacgtattt

SEQ ID NO: 745422 - DNA, 13 bp, C. elegans
ttttgactacatt

SEQ ID NO: 745423 - DNA, 13 bp, C. elegans
ttttgactatatt

SEQ ID NO: 745424 - DNA, 13 bp, C. elegans
ttttgactcaaat

SEQ ID NO: 745425 - DNA, 13 bp, C. elegans
ttttgactcaccc

SEQ ID NO: 745426 - DNA, 13 bp, C. elegans
ttttgactgaaaa

SEQ ID NO: 745427 - DNA, 13 bp, C. elegans
ttttgacttctga

SEQ ID NO: 745428 - DNA, 13 bp, C. elegans
ttttgacttgtta

SEQ ID NO: 745429 - DNA, 13 bp, C. elegans
ttttgacttttca

SEQ ID NO: 745430 - DNA, 13 bp, C. elegans
ttttgagaaaaaa

SEQ ID NO: 745431 - DNA, 13 bp, C. elegans
ttttgagaaaaat

SEQ ID NO: 745432 - DNA, 13 bp, C. elegans
ttttgagaaaact

SEQ ID NO: 745433 - DNA, 13 bp, C. elegans
ttttgagaaaagt

SEQ ID NO: 745434 - DNA, 13 bp, C. elegans
ttttgagaaaata

SEQ ID NO: 745435 - DNA, 13 bp, C. elegans
ttttgagaaaatc

SEQ ID NO: 745436 - DNA, 13 bp, C. elegans
ttttgagaaaatg

SEQ ID NO: 745437 - DNA, 13 bp, C. elegans
ttttgagaaatca

SEQ ID NO: 745438 - DNA, 13 bp, C. elegans
ttttgagaaatta

SEQ ID NO: 745439 - DNA, 13 bp, C. elegans
ttttgagaacaac

SEQ ID NO: 745440 - DNA, 13 bp, C. elegans
ttttgagaacaat

SEQ ID NO: 745441 - DNA, 13 bp, C. elegans
ttttgagaactgt

SEQ ID NO: 745442 - DNA, 13 bp, C. elegans
ttttgagaagaaa

SEQ ID NO: 745443 - DNA, 13 bp, C. elegans
ttttgagaagctt

SEQ ID NO: 745444 - DNA, 13 bp, C. elegans
ttttgagaagtct

SEQ ID NO: 745445 - DNA, 13 bp, C. elegans
ttttgagaagttt

SEQ ID NO: 745446 - DNA, 13 bp, C. elegans
ttttgagaataaa

SEQ ID NO: 745447 - DNA, 13 bp, C. elegans
ttttgagaataat

SEQ ID NO: 745448 - DNA, 13 bp, C. elegans
ttttgagaatatt

SEQ ID NO: 745449 - DNA, 13 bp, C. elegans
ttttgagaatctt

SEQ ID NO: 745450 - DNA, 13 bp, C. elegans
ttttgagaattct

SEQ ID NO: 745451 - DNA, 13 bp, C. elegans
ttttgagaattga

SEQ ID NO: 745452 - DNA, 13 bp, C. elegans
ttttgagacaaaa

SEQ ID NO: 745453 - DNA, 13 bp, C. elegans
ttttgagacaatt

SEQ ID NO: 745454 - DNA, 13 bp, C. elegans
ttttgagacattt

SEQ ID NO: 745455 - DNA, 13 bp, C. elegans
ttttgagagaaaa

SEQ ID NO: 745456 - DNA, 13 bp, C. elegans
ttttgagagagaa

SEQ ID NO: 745457 - DNA, 13 bp, C. elegans
ttttgagagattt

SEQ ID NO: 745458 - DNA, 13 bp, C. elegans
ttttgagagtttc

SEQ ID NO: 745459 - DNA, 13 bp, C. elegans
ttttgagatgaaa

SEQ ID NO: 745460 - DNA, 13 bp, C. elegans
ttttgagattcaa

SEQ ID NO: 745461 - DNA, 13 bp, C. elegans
ttttgagattcta

SEQ ID NO: 745462 - DNA, 13 bp, C. elegans
ttttgagattctt

SEQ ID NO: 745463 - DNA, 13 bp, C. elegans
ttttgagattgaa

SEQ ID NO: 745464 - DNA, 13 bp, C. elegans
ttttgagattttc

SEQ ID NO: 745465 - DNA, 13 bp, C. elegans
ttttgagcaaaaa

SEQ ID NO: 745466 - DNA, 13 bp, C. elegans
ttttgagcaaagt

SEQ ID NO: 745467 - DNA, 13 bp, C. elegans
ttttgagcaattt

SEQ ID NO: 745468 - DNA, 13 bp, C. elegans
ttttgagcacaaa

SEQ ID NO: 745469 - DNA, 13 bp, C. elegans
ttttgagcacttt

SEQ ID NO: 745470 - DNA, 13 bp, C. elegans
ttttgagcatatt

SEQ ID NO: 745471 - DNA, 13 bp, C. elegans
ttttgagcattat

SEQ ID NO: 745472 - DNA, 13 bp, C. elegans
ttttgagcatttg

SEQ ID NO: 745473 - DNA, 13 bp, C. elegans
ttttgagcatttt

SEQ ID NO: 745474 - DNA, 13 bp, C. elegans
ttttgagccaaaa

SEQ ID NO: 745475 - DNA, 13 bp, C. elegans
ttttgagccaact

SEQ ID NO: 745476 - DNA, 13 bp, C. elegans
ttttgagccattt

SEQ ID NO: 745477 - DNA, 13 bp, C. elegans
ttttgagccgcca

SEQ ID NO: 745478 - DNA, 13 bp, C. elegans
ttttgagcgaaat

SEQ ID NO: 745479 - DNA, 13 bp, C. elegans
ttttgagcgtttt

SEQ ID NO: 745480 - DNA, 13 bp, C. elegans
ttttgagctaaaa

SEQ ID NO: 745481 - DNA, 13 bp, C. elegans
ttttgagctataa

SEQ ID NO: 745482 - DNA, 13 bp, C. elegans
ttttgagctcatt

SEQ ID NO: 745483 - DNA, 13 bp, C. elegans
ttttgagctgaaa

SEQ ID NO: 745484 - DNA, 13 bp, C. elegans
ttttgagctgatt

SEQ ID NO: 745485 - DNA, 13 bp, C. elegans
ttttgagcttttg

SEQ ID NO: 745486 - DNA, 13 bp, C. elegans
ttttgaggaaaaa

SEQ ID NO: 745487 - DNA, 13 bp, C. elegans
ttttgaggaaatc

SEQ ID NO: 745488 - DNA, 13 bp, C. elegans
ttttgaggaaatt

SEQ ID NO: 745489 - DNA, 13 bp, C. elegans
ttttgaggaattt

SEQ ID NO: 745490 - DNA, 13 bp, C. elegans
ttttgaggcaaca

SEQ ID NO: 745491 - DNA, 13 bp, C. elegans
ttttgaggttttc

SEQ ID NO: 745492 - DNA, 13 bp, C. elegans
ttttgagtaaaac

SEQ ID NO: 745493 - DNA, 13 bp, C. elegans
ttttgagtaaaat

SEQ ID NO: 745494 - DNA, 13 bp, C. elegans
ttttgagttccga

SEQ ID NO: 745495 - DNA, 13 bp, C. elegans
ttttgagttcggt

SEQ ID NO: 745496 - DNA, 13 bp, C. elegans
ttttgagttgaaa

SEQ ID NO: 745497 - DNA, 13 bp, C. elegans
ttttgagtttgag

SEQ ID NO: 745498 - DNA, 13 bp, C. elegans
ttttgagttttca

SEQ ID NO: 745499 - DNA, 13 bp, C. elegans
ttttgagttttcg

SEQ ID NO: 745500 - DNA, 13 bp, C. elegans
ttttgataaaaac

SEQ ID NO: 745501 - DNA, 13 bp, C. elegans
ttttgataaaaga

SEQ ID NO: 745502 - DNA, 13 bp, C. elegans
ttttgataaaatg

SEQ ID NO: 745503 - DNA, 13 bp, C. elegans
ttttgataaactt

SEQ ID NO: 745504 - DNA, 13 bp, C. elegans
ttttgataaagat

SEQ ID NO: 745505 - DNA, 13 bp, C. elegans
ttttgataaagta

SEQ ID NO: 745506 - DNA, 13 bp, C. elegans
ttttgataaattc

SEQ ID NO: 745507 - DNA, 13 bp, C. elegans
ttttgataactct

SEQ ID NO: 745508 - DNA, 13 bp, C. elegans
ttttgataatctt

SEQ ID NO: 745509 - DNA, 13 bp, C. elegans
ttttgataatgaa

SEQ ID NO: 745510 - DNA, 13 bp, C. elegans
ttttgataattga

SEQ ID NO: 745511 - DNA, 13 bp, C. elegans
ttttgatacgaaa

SEQ ID NO: 745512 - DNA, 13 bp, C. elegans
ttttgatactaaa

SEQ ID NO: 745513 - DNA, 13 bp, C. elegans
ttttgatactaat

SEQ ID NO: 745514 - DNA, 13 bp, C. elegans
ttttgatagaact

SEQ ID NO: 745515 - DNA, 13 bp, C. elegans
ttttgatagaata

SEQ ID NO: 745516 - DNA, 13 bp, C. elegans
ttttgatagcttt

SEQ ID NO: 745517 - DNA, 13 bp, C. elegans
ttttgatatcaaa

SEQ ID NO: 745518 - DNA, 13 bp, C. elegans
ttttgatatctct

SEQ ID NO: 745519 - DNA, 13 bp, C. elegans
ttttgatatgaaa

SEQ ID NO: 745520 - DNA, 13 bp, C. elegans
ttttgatattatc

SEQ ID NO: 745521 - DNA, 13 bp, C. elegans
ttttgatattcaa

SEQ ID NO: 745522 - DNA, 13 bp, C. elegans
ttttgatcaaaaa

SEQ ID NO: 745523 - DNA, 13 bp, C. elegans
ttttgatcaaact

SEQ ID NO: 745524 - DNA, 13 bp, C. elegans
ttttgatcagaaa

SEQ ID NO: 745525 - DNA, 13 bp, C. elegans
ttttgatcattga

SEQ ID NO: 745526 - DNA, 13 bp, C. elegans
ttttgatcgaaat

SEQ ID NO: 745527 - DNA, 13 bp, C. elegans
ttttgatcgactt

SEQ ID NO: 745528 - DNA, 13 bp, C. elegans
ttttgatcgagtt

SEQ ID NO: 745529 - DNA, 13 bp, C. elegans
ttttgatctaaaa

SEQ ID NO: 745530 - DNA, 13 bp, C. elegans
ttttgatctaaat

SEQ ID NO: 745531 - DNA, 13 bp, C. elegans
ttttgatctacat

SEQ ID NO: 745532 - DNA, 13 bp, C. elegans
ttttgatctaccc

SEQ ID NO: 745533 - DNA, 13 bp, C. elegans
ttttgatctacct

SEQ ID NO: 745534 - DNA, 13 bp, C. elegans
ttttgatctacga

SEQ ID NO: 745535 - DNA, 13 bp, C. elegans
ttttgatcttaaa

SEQ ID NO: 745536 - DNA, 13 bp, C. elegans
ttttgatgaaact

SEQ ID NO: 745537 - DNA, 13 bp, C. elegans
ttttgatgaacaa

SEQ ID NO: 745538 - DNA, 13 bp, C. elegans
ttttgatgaatct

SEQ ID NO: 745539 - DNA, 13 bp, C. elegans
ttttgatgaatta

SEQ ID NO: 745540 - DNA, 13 bp, C. elegans
ttttgatgatgaa

SEQ ID NO: 745541 - DNA, 13 bp, C. elegans
ttttgatgatgat

SEQ ID NO: 745542 - DNA, 13 bp, C. elegans
ttttgatgatttc

SEQ ID NO: 745543 - DNA, 13 bp, C. elegans
ttttgatgcaaaa

SEQ ID NO: 745544 - DNA, 13 bp, C. elegans
ttttgatgcattt

SEQ ID NO: 745545 - DNA, 13 bp, C. elegans
ttttgatgcgaaa

SEQ ID NO: 745546 - DNA, 14 bp, C. elegans
ttttgatggaaaaa

SEQ ID NO: 745547 - DNA, 13 bp, C. elegans
ttttgatggaata

SEQ ID NO: 745548 - DNA, 13 bp, C. elegans
ttttgatgtacat

SEQ ID NO: 745549 - DNA, 13 bp, C. elegans
ttttgatgttcca

SEQ ID NO: 745550 - DNA, 13 bp, C. elegans
ttttgatgttgaa

SEQ ID NO: 745551 - DNA, 13 bp, C. elegans
ttttgattacaaa

SEQ ID NO: 745552 - DNA, 13 bp, C. elegans
ttttgattatcaa

SEQ ID NO: 745553 - DNA, 13 bp, C. elegans
ttttgattattca

SEQ ID NO: 745554 - DNA, 13 bp, C. elegans
ttttgattcaaag

SEQ ID NO: 745555 - DNA, 13 bp, C. elegans
ttttgattcagaa

SEQ ID NO: 745556 - DNA, 13 bp, C. elegans
ttttgattctgaa

SEQ ID NO: 745557 - DNA, 13 bp, C. elegans
ttttgattgaaaa

SEQ ID NO: 745558 - DNA, 13 bp, C. elegans
ttttgattgaaat

SEQ ID NO: 745559 - DNA, 13 bp, C. elegans
ttttgattgagag

SEQ ID NO: 745560 - DNA, 13 bp, C. elegans
ttttgattgataa

SEQ ID NO: 745561 - DNA, 13 bp, C. elegans
ttttgattggaaa

SEQ ID NO: 745562 - DNA, 13 bp, C. elegans
ttttgattggaat

SEQ ID NO: 745563 - DNA, 13 bp, C. elegans
ttttgattgtgag

SEQ ID NO: 745564 - DNA, 13 bp, C. elegans
ttttgatttaatc

SEQ ID NO: 745565 - DNA, 13 bp, C. elegans
ttttgatttcaag

SEQ ID NO: 745566 - DNA, 13 bp, C. elegans
ttttgatttcata

SEQ ID NO: 745567 - DNA, 13 bp, C. elegans
ttttgatttccaa

SEQ ID NO: 745568 - DNA, 13 bp, C. elegans
ttttgatttcgaa

SEQ ID NO: 745569 - DNA, 13 bp, C. elegans
ttttgatttctaa

SEQ ID NO: 745570 - DNA, 13 bp, C. elegans
ttttgatttctgg

SEQ ID NO: 745571 - DNA, 13 bp, C. elegans
ttttgatttgaca

SEQ ID NO: 745572 - DNA, 13 bp, C. elegans
ttttgattttaca

SEQ ID NO: 745573 - DNA, 13 bp, C. elegans
ttttgattttcag

SEQ ID NO: 745574 - DNA, 13 bp, C. elegans
ttttgattttccc

SEQ ID NO: 745575 - DNA, 13 bp, C. elegans
ttttgattttccg

SEQ ID NO: 745576 - DNA, 13 bp, C. elegans
ttttgattttgca

SEQ ID NO: 745577 - DNA, 13 bp, C. elegans
ttttgcaaaaaaa

SEQ ID NO: 745578 - DNA, 13 bp, C. elegans
ttttgcaaaaaac

SEQ ID NO: 745579 - DNA, 13 bp, C. elegans
ttttgcaaaaaag

SEQ ID NO: 745580 - DNA, 13 bp, C. elegans
ttttgcaaaaaat

SEQ ID NO: 745581 - DNA, 13 bp, C. elegans
ttttgcaaaaatc

SEQ ID NO: 745582 - DNA, 13 bp, C. elegans
ttttgcaaaacaa

SEQ ID NO: 745583 - DNA, 13 bp, C. elegans
ttttgcaaaacgt

SEQ ID NO: 745584 - DNA, 13 bp, C. elegans
ttttgcaaaactt

SEQ ID NO: 745585 - DNA, 13 bp, C. elegans
ttttgcaaaagaa

SEQ ID NO: 745586 - DNA, 13 bp, C. elegans
ttttgcaaaattt

SEQ ID NO: 745587 - DNA, 13 bp, C. elegans
ttttgcaaagttt

SEQ ID NO: 745588 - DNA, 13 bp, C. elegans
ttttgcaaatatt

SEQ ID NO: 745589 - DNA, 13 bp, C. elegans
ttttgcaaatcaa

SEQ ID NO: 745590 - DNA, 13 bp, C. elegans
ttttgcaaattca

SEQ ID NO: 745591 - DNA, 13 bp, C. elegans
ttttgcaaatttg

SEQ ID NO: 745592 - DNA, 13 bp, C. elegans
ttttgcaaatttt

SEQ ID NO: 745593 - DNA, 13 bp, C. elegans
ttttgcaacacat

SEQ ID NO: 745594 - DNA, 13 bp, C. elegans
ttttgcaacactt

SEQ ID NO: 745595 - DNA, 13 bp, C. elegans
ttttgcaactaaa

SEQ ID NO: 745596 - DNA, 13 bp, C. elegans
ttttgcaactctg

SEQ ID NO: 745597 - DNA, 13 bp, C. elegans
ttttgcaacttct

SEQ ID NO: 745598 - DNA, 13 bp, C. elegans
ttttgcaactttc

SEQ ID NO: 745599 - DNA, 13 bp, C. elegans
ttttgcaactttt

SEQ ID NO: 745600 - DNA, 13 bp, C. elegans
ttttgcaagtatt

SEQ ID NO: 745601 - DNA, 13 bp, C. elegans
ttttgcaagttca

SEQ ID NO: 745602 - DNA, 13 bp, C. elegans
ttttgcaagtttt

SEQ ID NO: 745603 - DNA, 13 bp, C. elegans
ttttgcaatattt

SEQ ID NO: 745604 - DNA, 13 bp, C. elegans
ttttgcaatcaat

SEQ ID NO: 745605 - DNA, 13 bp, C. elegans
ttttgcaatcatt

SEQ ID NO: 745606 - DNA, 13 bp, C. elegans
ttttgcaatcttt

SEQ ID NO: 745607 - DNA, 13 bp, C. elegans
ttttgcaattatc

SEQ ID NO: 745608 - DNA, 13 bp, C. elegans
ttttgcaattcaa

SEQ ID NO: 745609 - DNA, 13 bp, C. elegans
ttttgcaatttct

SEQ ID NO: 745610 - DNA, 13 bp, C. elegans
ttttgcaatttga

SEQ ID NO: 745611 - DNA, 13 bp, C. elegans
ttttgcacaaaaa

SEQ ID NO: 745612 - DNA, 13 bp, C. elegans
ttttgcacaaaat

SEQ ID NO: 745613 - DNA, 13 bp, C. elegans
ttttgcacaacaa

SEQ ID NO: 745614 - DNA, 13 bp, C. elegans
ttttgcacaattt

SEQ ID NO: 745615 - DNA, 13 bp, C. elegans
ttttgcacacttt

SEQ ID NO: 745616 - DNA, 13 bp, C. elegans
ttttgcacataaa

SEQ ID NO: 745617 - DNA, 13 bp, C. elegans
ttttgcacatttt

SEQ ID NO: 745618 - DNA, 13 bp, C. elegans
ttttgcaccaaaa

SEQ ID NO: 745619 - DNA, 13 bp, C. elegans
ttttgcaccctct

SEQ ID NO: 745620 - DNA, 13 bp, C. elegans
ttttgcacctttt

SEQ ID NO: 745621 - DNA, 13 bp, C. elegans
ttttgcacgaaaa

SEQ ID NO: 745622 - DNA, 13 bp, C. elegans
ttttgcacgtatt

SEQ ID NO: 745623 - DNA, 13 bp, C. elegans
ttttgcactgaca

SEQ ID NO: 745624 - DNA, 13 bp, C. elegans
ttttgcagaaaaa

SEQ ID NO: 745625 - DNA, 13 bp, C. elegans
ttttgcagaaaag

SEQ ID NO: 745626 - DNA, 13 bp, C. elegans
ttttgcagaaaat

SEQ ID NO: 745627 - DNA, 13 bp, C. elegans
ttttgcagaattg

SEQ ID NO: 745628 - DNA, 13 bp, C. elegans
ttttgcagaattt

SEQ ID NO: 745629 - DNA, 13 bp, C. elegans
ttttgcagagttt

SEQ ID NO: 745630 - DNA, 13 bp, C. elegans
ttttgcagattaa

SEQ ID NO: 745631 - DNA, 13 bp, C. elegans
ttttgcagatttt

SEQ ID NO: 745632 - DNA, 13 bp, C. elegans
ttttgcagcgaaa

SEQ ID NO: 745633 - DNA, 13 bp, C. elegans
ttttgcagctttc

SEQ ID NO: 745634 - DNA, 13 bp, C. elegans
ttttgcaggaaaa

SEQ ID NO: 745635 - DNA, 13 bp, C. elegans
ttttgcaggaaat

SEQ ID NO: 745636 - DNA, 13 bp, C. elegans
ttttgcaggtttt

SEQ ID NO: 745637 - DNA, 13 bp, C. elegans
ttttgcagtaaaa

SEQ ID NO: 745638 - DNA, 13 bp, C. elegans
ttttgcagtcaaa

SEQ ID NO: 745639 - DNA, 13 bp, C. elegans
ttttgcagtgaca

SEQ ID NO: 745640 - DNA, 13 bp, C. elegans
ttttgcagttctc

SEQ ID NO: 745641 - DNA, 13 bp, C. elegans
ttttgcatacatt

SEQ ID NO: 745642 - DNA, 13 bp, C. elegans
ttttgcatagttt

SEQ ID NO: 745643 - DNA, 13 bp, C. elegans
ttttgcatatatt

SEQ ID NO: 745644 - DNA, 13 bp, C. elegans
ttttgcatcattt

SEQ ID NO: 745645 - DNA, 13 bp, C. elegans
ttttgcatctaaa

SEQ ID NO: 745646 - DNA, 13 bp, C. elegans
ttttgcatgaaaa

SEQ ID NO: 745647 - DNA, 13 bp, C. elegans
ttttgcatgcctt

SEQ ID NO: 745648 - DNA, 13 bp, C. elegans
ttttgcattaaaa

SEQ ID NO: 745649 - DNA, 13 bp, C. elegans
ttttgcattcaaa

SEQ ID NO: 745650 - DNA, 13 bp, C. elegans
ttttgcattgaaa

SEQ ID NO: 745651 - DNA, 13 bp, C. elegans
ttttgcatttatc

SEQ ID NO: 745652 - DNA, 13 bp, C. elegans
ttttgcatttccc

SEQ ID NO: 745653 - DNA, 13 bp, C. elegans
ttttgcattttgc

SEQ ID NO: 745654 - DNA, 13 bp, C. elegans
ttttgccaaaaaa

SEQ ID NO: 745655 - DNA, 13 bp, C. elegans
ttttgccaaaaag

SEQ ID NO: 745656 - DNA, 13 bp, C. elegans
ttttgccaaaaga

SEQ ID NO: 745657 - DNA, 13 bp, C. elegans
ttttgccaaattc

SEQ ID NO: 745658 - DNA, 13 bp, C. elegans
ttttgccaaattt

SEQ ID NO: 745659 - DNA, 13 bp, C. elegans
ttttgccaacttt

SEQ ID NO: 745660 - DNA, 13 bp, C. elegans
ttttgccaagttt

SEQ ID NO: 745661 - DNA, 13 bp, C. elegans
ttttgccaataaa

SEQ ID NO: 745662 - DNA, 13 bp, C. elegans
ttttgccaattat

SEQ ID NO: 745663 - DNA, 13 bp, C. elegans
ttttgccaattta

SEQ ID NO: 745664 - DNA, 13 bp, C. elegans
ttttgccaatttg

SEQ ID NO: 745665 - DNA, 13 bp, C. elegans
ttttgccaatttt

SEQ ID NO: 745666 - DNA, 13 bp, C. elegans
ttttgccacaaaa

SEQ ID NO: 745667 - DNA, 13 bp, C. elegans
ttttgccacattt

SEQ ID NO: 745668 - DNA, 13 bp, C. elegans
ttttgccactcat

SEQ ID NO: 745669 - DNA, 13 bp, C. elegans
ttttgccactttt

SEQ ID NO: 745670 - DNA, 13 bp, C. elegans
ttttgccagtact

SEQ ID NO: 745671 - DNA, 13 bp, C. elegans
ttttgccagtttt

SEQ ID NO: 745672 - DNA, 13 bp, C. elegans
ttttgccattatt

SEQ ID NO: 745673 - DNA, 13 bp, C. elegans
ttttgcccaactt

SEQ ID NO: 745674 - DNA, 13 bp, C. elegans
ttttgcccaattt

SEQ ID NO: 745675 - DNA, 13 bp, C. elegans
ttttgcccccaaa

SEQ ID NO: 745676 - DNA, 13 bp, C. elegans
ttttgccgaaaaa

SEQ ID NO: 745677 - DNA, 13 bp, C. elegans
ttttgccgaataa

SEQ ID NO: 745678 - DNA, 13 bp, C. elegans
ttttgccgcaaaa

SEQ ID NO: 745679 - DNA, 13 bp, C. elegans
ttttgccgccaat

SEQ ID NO: 745680 - DNA, 13 bp, C. elegans
ttttgcctggaaa

SEQ ID NO: 745681 - DNA, 13 bp, C. elegans
ttttgccttattc

SEQ ID NO: 745682 - DNA, 13 bp, C. elegans
ttttgccttttga

SEQ ID NO: 745683 - DNA, 13 bp, C. elegans
ttttgcgaaaata

SEQ ID NO: 745684 - DNA, 13 bp, C. elegans
ttttgcgaagaaa

SEQ ID NO: 745685 - DNA, 13 bp, C. elegans
ttttgcgattttc

SEQ ID NO: 745686 - DNA, 13 bp, C. elegans
ttttgcgcaaaaa

SEQ ID NO: 745687 - DNA, 13 bp, C. elegans
ttttgcgccgaaa

SEQ ID NO: 745688 - DNA, 13 bp, C. elegans
ttttgcggaaaat

SEQ ID NO: 745689 - DNA, 13 bp, C. elegans
ttttgcggaaatt

SEQ ID NO: 745690 - DNA, 13 bp, C. elegans
ttttgcggacttt

SEQ ID NO: 745691 - DNA, 13 bp, C. elegans
ttttgcggatttt

SEQ ID NO: 745692 - DNA, 13 bp, C. elegans
ttttgcgtcaaaa

SEQ ID NO: 745693 - DNA, 13 bp, C. elegans
ttttgcgttgaaa

SEQ ID NO: 745694 - DNA, 13 bp, C. elegans
ttttgctaaaatc

SEQ ID NO: 745695 - DNA, 13 bp, C. elegans
ttttgctaataaa

SEQ ID NO: 745696 - DNA, 13 bp, C. elegans
ttttgctataaaa

SEQ ID NO: 745697 - DNA, 13 bp, C. elegans
ttttgctataaat

SEQ ID NO: 745698 - DNA, 13 bp, C. elegans
ttttgctcaaagt

SEQ ID NO: 745699 - DNA, 13 bp, C. elegans
ttttgctcaactt

SEQ ID NO: 745700 - DNA, 13 bp, C. elegans
ttttgctcaataa

SEQ ID NO: 745701 - DNA, 13 bp, C. elegans
ttttgctcaattt

SEQ ID NO: 745702 - DNA, 13 bp, C. elegans
ttttgctcacaat

SEQ ID NO: 745703 - DNA, 13 bp, C. elegans
ttttgctcattct

SEQ ID NO: 745704 - DNA, 13 bp, C. elegans
ttttgctccaaat

SEQ ID NO: 745705 - DNA, 13 bp, C. elegans
ttttgctccaact

SEQ ID NO: 745706 - DNA, 13 bp, C. elegans
ttttgctccaatt

SEQ ID NO: 745707 - DNA, 13 bp, C. elegans
ttttgctccgaac

SEQ ID NO: 745708 - DNA, 13 bp, C. elegans
ttttgctcgaatt

SEQ ID NO: 745709 - DNA, 13 bp, C. elegans
ttttgctcgattt

SEQ ID NO: 745710 - DNA, 13 bp, C. elegans
ttttgctctaaat

SEQ ID NO: 745711 - DNA, 13 bp, C. elegans
ttttgctctaatt

SEQ ID NO: 745712 - DNA, 13 bp, C. elegans
ttttgctctcaaa

SEQ ID NO: 745713 - DNA, 13 bp, C. elegans
ttttgctctttca

SEQ ID NO: 745714 - DNA, 13 bp, C. elegans
ttttgctgaaatt

SEQ ID NO: 745715 - DNA, 13 bp, C. elegans
ttttgctgaataa

SEQ ID NO: 745716 - DNA, 13 bp, C. elegans
ttttgctgaattt

SEQ ID NO: 745717 - DNA, 13 bp, C. elegans
ttttgctgattct

SEQ ID NO: 745718 - DNA, 13 bp, C. elegans
ttttgctgattta

SEQ ID NO: 745719 - DNA, 13 bp, C. elegans
ttttgctgatttc

SEQ ID NO: 745720 - DNA, 13 bp, C. elegans
ttttgctgtaaaa

SEQ ID NO: 745721 - DNA, 13 bp, C. elegans
ttttgctgtttca

SEQ ID NO: 745722 - DNA, 13 bp, C. elegans
ttttgcttaaaat

SEQ ID NO: 745723 - DNA, 13 bp, C. elegans
ttttgcttaaatt

SEQ ID NO: 745724 - DNA, 13 bp, C. elegans
ttttgcttcaaaa

SEQ ID NO: 745725 - DNA, 15 bp, C. elegans
ttttgcttcaaaaaa

SEQ ID NO: 745726 - DNA, 13 bp, C. elegans
ttttgcttcataa

SEQ ID NO: 745727 - DNA, 13 bp, C. elegans
ttttgctttcaaa

SEQ ID NO: 745728 - DNA, 13 bp, C. elegans
ttttggaaaaaaa

SEQ ID NO: 745729 - DNA, 13 bp, C. elegans
ttttggaaaaaac

SEQ ID NO: 745730 - DNA, 13 bp, C. elegans
ttttggaaaaaat

SEQ ID NO: 745731 - DNA, 13 bp, C. elegans
ttttggaaaaagg

SEQ ID NO: 745732 - DNA, 13 bp, C. elegans
ttttggaaaaatc

SEQ ID NO: 745733 - DNA, 13 bp, C. elegans
ttttggaaaaatg

SEQ ID NO: 745734 - DNA, 13 bp, C. elegans
ttttggaaaagaa

SEQ ID NO: 745735 - DNA, 13 bp, C. elegans
ttttggaaaataa

SEQ ID NO: 745736 - DNA, 13 bp, C. elegans
ttttggaaaatat

SEQ ID NO: 745737 - DNA, 13 bp, C. elegans
ttttggaaaatca

SEQ ID NO: 745738 - DNA, 13 bp, C. elegans
ttttggaaaatgc

SEQ ID NO: 745739 - DNA, 13 bp, C. elegans
ttttggaaaatgt

SEQ ID NO: 745740 - DNA, 13 bp, C. elegans
ttttggaaaatta

SEQ ID NO: 745741 - DNA, 13 bp, C. elegans
ttttggaaaattg

SEQ ID NO: 745742 - DNA, 13 bp, C. elegans
ttttggaaacaaa

SEQ ID NO: 745743 - DNA, 13 bp, C. elegans
ttttggaaactat

SEQ ID NO: 745744 - DNA, 13 bp, C. elegans
ttttggaaagaaa

SEQ ID NO: 745745 - DNA, 13 bp, C. elegans
ttttggaaagtct

SEQ ID NO: 745746 - DNA, 13 bp, C. elegans
ttttggaaagtgt

SEQ ID NO: 745747 - DNA, 13 bp, C. elegans
ttttggaaagttt

SEQ ID NO: 745748 - DNA, 13 bp, C. elegans
ttttggaaatcaa

SEQ ID NO: 745749 - DNA, 13 bp, C. elegans
ttttggaaatcat

SEQ ID NO: 745750 - DNA, 13 bp, C. elegans
ttttggaaatcca

SEQ ID NO: 745751 - DNA, 13 bp, C. elegans
ttttggaaatgaa

SEQ ID NO: 745752 - DNA, 13 bp, C. elegans
ttttggaaatgtt

SEQ ID NO: 745753 - DNA, 13 bp, C. elegans
ttttggaaattat

SEQ ID NO: 745754 - DNA, 14 bp, C. elegans
ttttggaaatttca

SEQ ID NO: 745755 - DNA, 13 bp, C. elegans
ttttggaacaaaa

SEQ ID NO: 745756 - DNA, 13 bp, C. elegans
ttttggaacaact

SEQ ID NO: 745757 - DNA, 13 bp, C. elegans
ttttggaacatgt

SEQ ID NO: 745758 - DNA, 13 bp, C. elegans
ttttggaacgaaa

SEQ ID NO: 745759 - DNA, 13 bp, C. elegans
ttttggaacttat

SEQ ID NO: 745760 - DNA, 13 bp, C. elegans
ttttggaactttt

SEQ ID NO: 745761 - DNA, 13 bp, C. elegans
ttttggaagaaaa

SEQ ID NO: 745762 - DNA, 13 bp, C. elegans
ttttggaagaaat

SEQ ID NO: 745763 - DNA, 13 bp, C. elegans
ttttggaagagtt

SEQ ID NO: 745764 - DNA, 13 bp, C. elegans
ttttggaagatta

SEQ ID NO: 745765 - DNA, 13 bp, C. elegans
ttttggaagccga

SEQ ID NO: 745766 - DNA, 13 bp, C. elegans
ttttggaaggaaa

SEQ ID NO: 745767 - DNA, 13 bp, C. elegans
ttttggaaggatt

SEQ ID NO: 745768 - DNA, 13 bp, C. elegans
ttttggaagtaaa

SEQ ID NO: 745769 - DNA, 13 bp, C. elegans
ttttggaagtagt

SEQ ID NO: 745770 - DNA, 13 bp, C. elegans
ttttggaagtatt

SEQ ID NO: 745771 - DNA, 13 bp, C. elegans
ttttggaagtcaa

SEQ ID NO: 745772 - DNA, 13 bp, C. elegans
ttttggaagtgga

SEQ ID NO: 745773 - DNA, 13 bp, C. elegans
ttttggaagttgt

SEQ ID NO: 745774 - DNA, 13 bp, C. elegans
ttttggaagtttc

SEQ ID NO: 745775 - DNA, 13 bp, C. elegans
ttttggaataatt

SEQ ID NO: 745776 - DNA, 13 bp, C. elegans
ttttggaatactg

SEQ ID NO: 745777 - DNA, 13 bp, C. elegans
ttttggaatatgt

SEQ ID NO: 745778 - DNA, 13 bp, C. elegans
ttttggaatatta

SEQ ID NO: 745779 - DNA, 13 bp, C. elegans
ttttggaatattc

SEQ ID NO: 745780 - DNA, 13 bp, C. elegans
ttttggaatattg

SEQ ID NO: 745781 - DNA, 14 bp, C. elegans
ttttggaatcaaaa

SEQ ID NO: 745782 - DNA, 13 bp, C. elegans
ttttggaatcaat

SEQ ID NO: 745783 - DNA, 13 bp, C. elegans
ttttggaatgaaa

SEQ ID NO: 745784 - DNA, 13 bp, C. elegans
ttttggaattaaa

SEQ ID NO: 745785 - DNA, 13 bp, C. elegans
ttttggaattaat

SEQ ID NO: 745786 - DNA, 13 bp, C. elegans
ttttggaattaca

SEQ ID NO: 745787 - DNA, 13 bp, C. elegans
ttttggaattcca

SEQ ID NO: 745788 - DNA, 13 bp, C. elegans
ttttggaattgga

SEQ ID NO: 745789 - DNA, 13 bp, C. elegans
ttttggaatttaa

SEQ ID NO: 745790 - DNA, 13 bp, C. elegans
ttttggaatttca

SEQ ID NO: 745791 - DNA, 13 bp, C. elegans
ttttggaatttgc

SEQ ID NO: 745792 - DNA, 13 bp, C. elegans
ttttggacaaatt

SEQ ID NO: 745793 - DNA, 13 bp, C. elegans
ttttggacacaaa

SEQ ID NO: 745794 - DNA, 13 bp, C. elegans
ttttggacatttt

SEQ ID NO: 745795 - DNA, 13 bp, C. elegans
ttttggacccaaa

SEQ ID NO: 745796 - DNA, 13 bp, C. elegans
ttttggaccgagt

SEQ ID NO: 745797 - DNA, 13 bp, C. elegans
ttttggacgtttt

SEQ ID NO: 745798 - DNA, 13 bp, C. elegans
ttttggactaaaa

SEQ ID NO: 745799 - DNA, 13 bp, C. elegans
ttttggactgaaa

SEQ ID NO: 745800 - DNA, 13 bp, C. elegans
ttttggacttttc

SEQ ID NO: 745801 - DNA, 13 bp, C. elegans
ttttggacttttg

SEQ ID NO: 745802 - DNA, 13 bp, C. elegans
ttttggagaaaaa

SEQ ID NO: 745803 - DNA, 13 bp, C. elegans
ttttggagaaaac

SEQ ID NO: 745804 - DNA, 13 bp, C. elegans
ttttggagaaaca

SEQ ID NO: 745805 - DNA, 13 bp, C. elegans
ttttggagaagaa

SEQ ID NO: 745806 - DNA, 13 bp, C. elegans
ttttggagaagtt

SEQ ID NO: 745807 - DNA, 13 bp, C. elegans
ttttggagaattg

SEQ ID NO: 745808 - DNA, 13 bp, C. elegans
ttttggagacttt

SEQ ID NO: 745809 - DNA, 13 bp, C. elegans
ttttggagataaa

SEQ ID NO: 745810 - DNA, 13 bp, C. elegans
ttttggagattaa

SEQ ID NO: 745811 - DNA, 13 bp, C. elegans
ttttggagattta

SEQ ID NO: 745812 - DNA, 13 bp, C. elegans
ttttggagatttc

SEQ ID NO: 745813 - DNA, 13 bp, C. elegans
ttttggagcaaaa

SEQ ID NO: 745814 - DNA, 13 bp, C. elegans
ttttggagcaagt

SEQ ID NO: 745815 - DNA, 13 bp, C. elegans
ttttggagcaatt

SEQ ID NO: 745816 - DNA, 13 bp, C. elegans
ttttggagcacaa

SEQ ID NO: 745817 - DNA, 13 bp, C. elegans
ttttggagcacat

SEQ ID NO: 745818 - DNA, 13 bp, C. elegans
ttttggagcagtt

SEQ ID NO: 745819 - DNA, 13 bp, C. elegans
ttttggagcatca

SEQ ID NO: 745820 - DNA, 13 bp, C. elegans
ttttggagctttt

SEQ ID NO: 745821 - DNA, 13 bp, C. elegans
ttttggaggagga

SEQ ID NO: 745822 - DNA, 14 bp, C. elegans
ttttggaggatcaa

SEQ ID NO: 745823 - DNA, 13 bp, C. elegans
ttttggagggatt

SEQ ID NO: 745824 - DNA, 13 bp, C. elegans
ttttggaggttat

SEQ ID NO: 745825 - DNA, 13 bp, C. elegans
ttttggagtaaaa

SEQ ID NO: 745826 - DNA, 13 bp, C. elegans
ttttggagttgaa

SEQ ID NO: 745827 - DNA, 13 bp, C. elegans
ttttggagtttca

SEQ ID NO: 745828 - DNA, 13 bp, C. elegans
ttttggagttttc

SEQ ID NO: 745829 - DNA, 13 bp, C. elegans
ttttggataaatt

SEQ ID NO: 745830 - DNA, 13 bp, C. elegans
ttttggataatct

SEQ ID NO: 745831 - DNA, 13 bp, C. elegans
ttttggatatgaa

SEQ ID NO: 745832 - DNA, 13 bp, C. elegans
ttttggatcaaat

SEQ ID NO: 745833 - DNA, 13 bp, C. elegans
ttttggatcaatt

SEQ ID NO: 745834 - DNA, 13 bp, C. elegans
ttttggatcataa

SEQ ID NO: 745835 - DNA, 13 bp, C. elegans
ttttggatctaaa

SEQ ID NO: 745836 - DNA, 13 bp, C. elegans
ttttggatgaaaa

SEQ ID NO: 745837 - DNA, 13 bp, C. elegans
ttttggattgaaa

SEQ ID NO: 745838 - DNA, 13 bp, C. elegans
ttttggcaaaatg

SEQ ID NO: 745839 - DNA, 13 bp, C. elegans
ttttggcaaaatt

SEQ ID NO: 745840 - DNA, 13 bp, C. elegans
ttttggcaaacgt

SEQ ID NO: 745841 - DNA, 13 bp, C. elegans
ttttggcaaatgt

SEQ ID NO: 745842 - DNA, 13 bp, C. elegans
ttttggcaagttg

SEQ ID NO: 745843 - DNA, 13 bp, C. elegans
ttttggcaatcaa

SEQ ID NO: 745844 - DNA, 13 bp, C. elegans
ttttggcaattgc

SEQ ID NO: 745845 - DNA, 13 bp, C. elegans
ttttggcaatttc

SEQ ID NO: 745846 - DNA, 13 bp, C. elegans
ttttggcacaata

SEQ ID NO: 745847 - DNA, 13 bp, C. elegans
ttttggcacaatt

SEQ ID NO: 745848 - DNA, 13 bp, C. elegans
ttttggcacattt

SEQ ID NO: 745849 - DNA, 13 bp, C. elegans
ttttggcacgttt

SEQ ID NO: 745850 - DNA, 13 bp, C. elegans
ttttggcagaaaa

SEQ ID NO: 745851 - DNA, 13 bp, C. elegans
ttttggcaggaaa

SEQ ID NO: 745852 - DNA, 13 bp, C. elegans
ttttggcatattg

SEQ ID NO: 745853 - DNA, 13 bp, C. elegans
ttttggcatgttt

SEQ ID NO: 745854 - DNA, 13 bp, C. elegans
ttttggcatttat

SEQ ID NO: 745855 - DNA, 13 bp, C. elegans
ttttggcatttca

SEQ ID NO: 745856 - DNA, 13 bp, C. elegans
ttttggcattttc

SEQ ID NO: 745857 - DNA, 13 bp, C. elegans
ttttggccacttt

SEQ ID NO: 745858 - DNA, 13 bp, C. elegans
ttttggccagttt

SEQ ID NO: 745859 - DNA, 13 bp, C. elegans
ttttggccgaatt

SEQ ID NO: 745860 - DNA, 13 bp, C. elegans
ttttggccgattt

SEQ ID NO: 745861 - DNA, 13 bp, C. elegans
ttttggccggaaa

SEQ ID NO: 745862 - DNA, 13 bp, C. elegans
ttttggcctaaat

SEQ ID NO: 745863 - DNA, 13 bp, C. elegans
ttttggcgaaaaa

SEQ ID NO: 745864 - DNA, 13 bp, C. elegans
ttttggcgatttt

SEQ ID NO: 745865 - DNA, 13 bp, C. elegans
ttttggcggaaaa

SEQ ID NO: 745866 - DNA, 13 bp, C. elegans
ttttggcgggaaa

SEQ ID NO: 745867 - DNA, 13 bp, C. elegans
ttttggctaaaaa

SEQ ID NO: 745868 - DNA, 13 bp, C. elegans
ttttggctatttc

SEQ ID NO: 745869 - DNA, 13 bp, C. elegans
ttttggctcaact

SEQ ID NO: 745870 - DNA, 13 bp, C. elegans
ttttggctcattt

SEQ ID NO: 745871 - DNA, 13 bp, C. elegans
ttttggctccgcc

SEQ ID NO: 745872 - DNA, 13 bp, C. elegans
ttttggctgaaaa

SEQ ID NO: 745873 - DNA, 13 bp, C. elegans
ttttggctgattt

SEQ ID NO: 745874 - DNA, 13 bp, C. elegans
ttttggctggaaa

SEQ ID NO: 745875 - DNA, 13 bp, C. elegans
ttttggcttaaaa

SEQ ID NO: 745876 - DNA, 13 bp, C. elegans
ttttggcttctgg

SEQ ID NO: 745877 - DNA, 14 bp, C. elegans
ttttggcttctgga

SEQ ID NO: 745878 - DNA, 13 bp, C. elegans
ttttggcttgaaa

SEQ ID NO: 745879 - DNA, 13 bp, C. elegans
ttttggcttttga

SEQ ID NO: 745880 - DNA, 13 bp, C. elegans
ttttgggaaaaaa

SEQ ID NO: 745881 - DNA, 13 bp, C. elegans
ttttgggaaaaga

SEQ ID NO: 745882 - DNA, 13 bp, C. elegans
ttttgggaaaatt

SEQ ID NO: 745883 - DNA, 13 bp, C. elegans
ttttgggaaataa

SEQ ID NO: 745884 - DNA, 13 bp, C. elegans
ttttgggaaatgt

SEQ ID NO: 745885 - DNA, 13 bp, C. elegans
ttttgggaaattg

SEQ ID NO: 745886 - DNA, 13 bp, C. elegans
ttttgggaagttt

SEQ ID NO: 745887 - DNA, 13 bp, C. elegans
ttttgggaatttg

SEQ ID NO: 745888 - DNA, 13 bp, C. elegans
ttttgggacaaat

SEQ ID NO: 745889 - DNA, 13 bp, C. elegans
ttttgggacattt

SEQ ID NO: 745890 - DNA, 13 bp, C. elegans
ttttgggataaaa

SEQ ID NO: 745891 - DNA, 13 bp, C. elegans
ttttgggcaaaaa

SEQ ID NO: 745892 - DNA, 13 bp, C. elegans
ttttgggcaaatt

SEQ ID NO: 745893 - DNA, 13 bp, C. elegans
ttttgggcaattt

SEQ ID NO: 745894 - DNA, 13 bp, C. elegans
ttttgggcgattt

SEQ ID NO: 745895 - DNA, 13 bp, C. elegans
ttttggggaaaaa

SEQ ID NO: 745896 - DNA, 13 bp, C. elegans
ttttggggaaata

SEQ ID NO: 745897 - DNA, 13 bp, C. elegans
ttttggggatgaa

SEQ ID NO: 745898 - DNA, 13 bp, C. elegans
ttttggggctacc

SEQ ID NO: 745899 - DNA, 13 bp, C. elegans
ttttgggtaaaaa

SEQ ID NO: 745900 - DNA, 13 bp, C. elegans
ttttgggtatttc

SEQ ID NO: 745901 - DNA, 13 bp, C. elegans
ttttgggtcccgc

SEQ ID NO: 745902 - DNA, 13 bp, C. elegans
ttttgggtctcgc

SEQ ID NO: 745903 - DNA, 13 bp, C. elegans
ttttgggtcttga

SEQ ID NO: 745904 - DNA, 13 bp, C. elegans
ttttgggttccgc

SEQ ID NO: 745905 - DNA, 13 bp, C. elegans
ttttggtaaaatc

SEQ ID NO: 745906 - DNA, 13 bp, C. elegans
ttttggtacaaaa

SEQ ID NO: 745907 - DNA, 13 bp, C. elegans
ttttggtacattt

SEQ ID NO: 745908 - DNA, 13 bp, C. elegans
ttttggtagatta

SEQ ID NO: 745909 - DNA, 13 bp, C. elegans
ttttggtcaaaat

SEQ ID NO: 745910 - DNA, 13 bp, C. elegans
ttttggtcaaacc

SEQ ID NO: 745911 - DNA, 13 bp, C. elegans
ttttggtcagaaa

SEQ ID NO: 745912 - DNA, 13 bp, C. elegans
ttttggtcctaaa

SEQ ID NO: 745913 - DNA, 13 bp, C. elegans
ttttggtctcaaa

SEQ ID NO: 745914 - DNA, 13 bp, C. elegans
ttttggtgaaaat

SEQ ID NO: 745915 - DNA, 13 bp, C. elegans
ttttggtgaaatt

SEQ ID NO: 745916 - DNA, 13 bp, C. elegans
ttttggtgacaaa

SEQ ID NO: 745917 - DNA, 13 bp, C. elegans
ttttggtgctcca

SEQ ID NO: 745918 - DNA, 13 bp, C. elegans
ttttggtggaaaa

SEQ ID NO: 745919 - DNA, 13 bp, C. elegans
ttttggtggaatt

SEQ ID NO: 745920 - DNA, 13 bp, C. elegans
ttttggtggccga

SEQ ID NO: 745921 - DNA, 13 bp, C. elegans
ttttggtgtaaaa

SEQ ID NO: 745922 - DNA, 13 bp, C. elegans
ttttggtgtcaaa

SEQ ID NO: 745923 - DNA, 13 bp, C. elegans
ttttggtgtttca

SEQ ID NO: 745924 - DNA, 13 bp, C. elegans
ttttggttaaaaa

SEQ ID NO: 745925 - DNA, 13 bp, C. elegans
ttttggttcataa

SEQ ID NO: 745926 - DNA, 13 bp, C. elegans
ttttggttgaaaa

SEQ ID NO: 745927 - DNA, 13 bp, C. elegans
ttttggttggaaa

SEQ ID NO: 745928 - DNA, 13 bp, C. elegans
ttttggttgtaaa

SEQ ID NO: 745929 - DNA, 13 bp, C. elegans
ttttggtttaaaa

SEQ ID NO: 745930 - DNA, 14 bp, C. elegans
ttttggtttgatct

SEQ ID NO: 745931 - DNA, 13 bp, C. elegans
ttttggttttcaa

SEQ ID NO: 745932 - DNA, 13 bp, C. elegans
ttttggttttcca

SEQ ID NO: 745933 - DNA, 13 bp, C. elegans
ttttgtaaaaaag

SEQ ID NO: 745934 - DNA, 13 bp, C. elegans
ttttgtaaaaatc

SEQ ID NO: 745935 - DNA, 13 bp, C. elegans
ttttgtaaaacaa

SEQ ID NO: 745936 - DNA, 13 bp, C. elegans
ttttgtaaaagtt

SEQ ID NO: 745937 - DNA, 13 bp, C. elegans
ttttgtaaaatct

SEQ ID NO: 745938 - DNA, 13 bp, C. elegans
ttttgtaaaattg

SEQ ID NO: 745939 - DNA, 13 bp, C. elegans
ttttgtaaacttt

SEQ ID NO: 745940 - DNA, 13 bp, C. elegans
ttttgtaaagaac

SEQ ID NO: 745941 - DNA, 13 bp, C. elegans
ttttgtaaagatt

SEQ ID NO: 745942 - DNA, 13 bp, C. elegans
ttttgtaaatatg

SEQ ID NO: 745943 - DNA, 13 bp, C. elegans
ttttgtaaattac

SEQ ID NO: 745944 - DNA, 13 bp, C. elegans
ttttgtaaattct

SEQ ID NO: 745945 - DNA, 13 bp, C. elegans
ttttgtaacattt

SEQ ID NO: 745946 - DNA, 13 bp, C. elegans
ttttgtaactatt

SEQ ID NO: 745947 - DNA, 13 bp, C. elegans
ttttgtaacttgt

SEQ ID NO: 745948 - DNA, 13 bp, C. elegans
ttttgtaactttc

SEQ ID NO: 745949 - DNA, 13 bp, C. elegans
ttttgtaatcata

SEQ ID NO: 745950 - DNA, 13 bp, C. elegans
ttttgtacaaaaa

SEQ ID NO: 745951 - DNA, 13 bp, C. elegans
ttttgtacagtta

SEQ ID NO: 745952 - DNA, 13 bp, C. elegans
ttttgtacagttt

SEQ ID NO: 745953 - DNA, 13 bp, C. elegans
ttttgtacattta

SEQ ID NO: 745954 - DNA, 13 bp, C. elegans
ttttgtaccaatt

SEQ ID NO: 745955 - DNA, 13 bp, C. elegans
ttttgtactttca

SEQ ID NO: 745956 - DNA, 13 bp, C. elegans
ttttgtagaaaaa

SEQ ID NO: 745957 - DNA, 13 bp, C. elegans
ttttgtagaaata

SEQ ID NO: 745958 - DNA, 13 bp, C. elegans
ttttgtagaacat

SEQ ID NO: 745959 - DNA, 13 bp, C. elegans
ttttgtagaattg

SEQ ID NO: 745960 - DNA, 13 bp, C. elegans
ttttgtagatata

SEQ ID NO: 745961 - DNA, 14 bp, C. elegans
ttttgtagatcaac

SEQ ID NO: 745962 - DNA, 13 bp, C. elegans
ttttgtagcaatt

SEQ ID NO: 745963 - DNA, 13 bp, C. elegans
ttttgtagttgaa

SEQ ID NO: 745964 - DNA, 13 bp, C. elegans
ttttgtataaaac

SEQ ID NO: 745965 - DNA, 13 bp, C. elegans
ttttgtatacaaa

SEQ ID NO: 745966 - DNA, 13 bp, C. elegans
ttttgtatatcaa

SEQ ID NO: 745967 - DNA, 13 bp, C. elegans
ttttgtatcagtt

SEQ ID NO: 745968 - DNA, 13 bp, C. elegans
ttttgtatccaaa

SEQ ID NO: 745969 - DNA, 13 bp, C. elegans
ttttgtatctcaa

SEQ ID NO: 745970 - DNA, 13 bp, C. elegans
ttttgtatgaaat

SEQ ID NO: 745971 - DNA, 13 bp, C. elegans
ttttgtatgataa

SEQ ID NO: 745972 - DNA, 13 bp, C. elegans
ttttgtattatac

SEQ ID NO: 745973 - DNA, 13 bp, C. elegans
ttttgtattcaaa

SEQ ID NO: 745974 - DNA, 13 bp, C. elegans
ttttgtattcact

SEQ ID NO: 745975 - DNA, 13 bp, C. elegans
ttttgtattcctg

SEQ ID NO: 745976 - DNA, 13 bp, C. elegans
ttttgtatttcag

SEQ ID NO: 745977 - DNA, 13 bp, C. elegans
ttttgtcaaaaaa

SEQ ID NO: 745978 - DNA, 14 bp, C. elegans
ttttgtcaaaaatc

SEQ ID NO: 745979 - DNA, 13 bp, C. elegans
ttttgtcaaaact

SEQ ID NO: 745980 - DNA, 13 bp, C. elegans
ttttgtcaaacaa

SEQ ID NO: 745981 - DNA, 13 bp, C. elegans
ttttgtcaaatcg

SEQ ID NO: 745982 - DNA, 13 bp, C. elegans
ttttgtcaagttt

SEQ ID NO: 745983 - DNA, 13 bp, C. elegans
ttttgtcaataat

SEQ ID NO: 745984 - DNA, 13 bp, C. elegans
ttttgtcaattca

SEQ ID NO: 745985 - DNA, 13 bp, C. elegans
ttttgtcacaaat

SEQ ID NO: 745986 - DNA, 13 bp, C. elegans
ttttgtcagaaat

SEQ ID NO: 745987 - DNA, 13 bp, C. elegans
ttttgtcagcttt

SEQ ID NO: 745988 - DNA, 13 bp, C. elegans
ttttgtcagtgct

SEQ ID NO: 745989 - DNA, 13 bp, C. elegans
ttttgtcagttga

SEQ ID NO: 745990 - DNA, 13 bp, C. elegans
ttttgtcatcaaa

SEQ ID NO: 745991 - DNA, 13 bp, C. elegans
ttttgtcatcatt

SEQ ID NO: 745992 - DNA, 13 bp, C. elegans
ttttgtcattgaa

SEQ ID NO: 745993 - DNA, 13 bp, C. elegans
ttttgtccaaaaa

SEQ ID NO: 745994 - DNA, 13 bp, C. elegans
ttttgtccaaaac

SEQ ID NO: 745995 - DNA, 13 bp, C. elegans
ttttgtccattct

SEQ ID NO: 745996 - DNA, 13 bp, C. elegans
ttttgtccatttc

SEQ ID NO: 745997 - DNA, 13 bp, C. elegans
ttttgtcgaaaaa

SEQ ID NO: 745998 - DNA, 13 bp, C. elegans
ttttgtcgaaata

SEQ ID NO: 745999 - DNA, 13 bp, C. elegans
ttttgtcgaattt

SEQ ID NO: 746000 - DNA, 13 bp, C. elegans
ttttgtcgagaaa

SEQ ID NO: 746001 - DNA, 13 bp, C. elegans
ttttgtcgatttc

SEQ ID NO: 746002 - DNA, 13 bp, C. elegans
ttttgtctaaaat

SEQ ID NO: 746003 - DNA, 13 bp, C. elegans
ttttgtctataaa

SEQ ID NO: 746004 - DNA, 13 bp, C. elegans
ttttgtctgaaac

SEQ ID NO: 746005 - DNA, 13 bp, C. elegans
ttttgtctgccca

SEQ ID NO: 746006 - DNA, 13 bp, C. elegans
ttttgtcttaaaa

SEQ ID NO: 746007 - DNA, 13 bp, C. elegans
ttttgtcttcaaa

SEQ ID NO: 746008 - DNA, 13 bp, C. elegans
ttttgtgaaaaac

SEQ ID NO: 746009 - DNA, 13 bp, C. elegans
ttttgtgaaaata

SEQ ID NO: 746010 - DNA, 13 bp, C. elegans
ttttgtgaaaatt

SEQ ID NO: 746011 - DNA, 13 bp, C. elegans
ttttgtgaaagtt

SEQ ID NO: 746012 - DNA, 13 bp, C. elegans
ttttgtgaaatta

SEQ ID NO: 746013 - DNA, 13 bp, C. elegans
ttttgtgaaattc

SEQ ID NO: 746014 - DNA, 13 bp, C. elegans
ttttgtgaaattg

SEQ ID NO: 746015 - DNA, 13 bp, C. elegans
ttttgtgaagaaa

SEQ ID NO: 746016 - DNA, 13 bp, C. elegans
ttttgtgaatgaa

SEQ ID NO: 746017 - DNA, 13 bp, C. elegans
ttttgtgacaaaa

SEQ ID NO: 746018 - DNA, 13 bp, C. elegans
ttttgtgacactt

SEQ ID NO: 746019 - DNA, 14 bp, C. elegans
ttttgtgactattg

SEQ ID NO: 746020 - DNA, 13 bp, C. elegans
ttttgtgagaaaa

SEQ ID NO: 746021 - DNA, 13 bp, C. elegans
ttttgtgagaaac

SEQ ID NO: 746022 - DNA, 13 bp, C. elegans
ttttgtgagcttt

SEQ ID NO: 746023 - DNA, 13 bp, C. elegans
ttttgtgataaaa

SEQ ID NO: 746024 - DNA, 13 bp, C. elegans
ttttgtgataata

SEQ ID NO: 746025 - DNA, 13 bp, C. elegans
ttttgtgatatca

SEQ ID NO: 746026 - DNA, 13 bp, C. elegans
ttttgtgatctac

SEQ ID NO: 746027 - DNA, 13 bp, C. elegans
ttttgtgatgaaa

SEQ ID NO: 746028 - DNA, 13 bp, C. elegans
ttttgtgattcat

SEQ ID NO: 746029 - DNA, 13 bp, C. elegans
ttttgtgatttca

SEQ ID NO: 746030 - DNA, 13 bp, C. elegans
ttttgtgcaaaaa

SEQ ID NO: 746031 - DNA, 13 bp, C. elegans
ttttgtgcaaaat

SEQ ID NO: 746032 - DNA, 13 bp, C. elegans
ttttgtgcaactt

SEQ ID NO: 746033 - DNA, 13 bp, C. elegans
ttttgtgcagttt

SEQ ID NO: 746034 - DNA, 13 bp, C. elegans
ttttgtgccaaaa

SEQ ID NO: 746035 - DNA, 13 bp, C. elegans
ttttgtgccattt

SEQ ID NO: 746036 - DNA, 13 bp, C. elegans
ttttgtgctaaaa

SEQ ID NO: 746037 - DNA, 13 bp, C. elegans
ttttgtgctcatt

SEQ ID NO: 746038 - DNA, 13 bp, C. elegans
ttttgtgcttcaa

SEQ ID NO: 746039 - DNA, 13 bp, C. elegans
ttttgtggaaact

SEQ ID NO: 746040 - DNA, 13 bp, C. elegans
ttttgtggagaaa

SEQ ID NO: 746041 - DNA, 13 bp, C. elegans
ttttgtggcaaaa

SEQ ID NO: 746042 - DNA, 13 bp, C. elegans
ttttgtgggaaaa

SEQ ID NO: 746043 - DNA, 13 bp, C. elegans
ttttgtgtaaaaa

SEQ ID NO: 746044 - DNA, 13 bp, C. elegans
ttttgtgtaaata

SEQ ID NO: 746045 - DNA, 13 bp, C. elegans
ttttgtgtagatc

SEQ ID NO: 746046 - DNA, 13 bp, C. elegans
ttttgtgtcagtt

SEQ ID NO: 746047 - DNA, 13 bp, C. elegans
ttttgtgtcgatt

SEQ ID NO: 746048 - DNA, 13 bp, C. elegans
ttttgtgtgaaaa

SEQ ID NO: 746049 - DNA, 13 bp, C. elegans
ttttgtgtgcagt

SEQ ID NO: 746050 - DNA, 13 bp, C. elegans
ttttgtgttcaaa

SEQ ID NO: 746051 - DNA, 13 bp, C. elegans
ttttgttaaatga

SEQ ID NO: 746052 - DNA, 13 bp, C. elegans
ttttgttaaatgc

SEQ ID NO: 746053 - DNA, 13 bp, C. elegans
ttttgttaacaaa

SEQ ID NO: 746054 - DNA, 13 bp, C. elegans
ttttgttaacatt

SEQ ID NO: 746055 - DNA, 13 bp, C. elegans
ttttgttaacttc

SEQ ID NO: 746056 - DNA, 13 bp, C. elegans
ttttgttaatgaa

SEQ ID NO: 746057 - DNA, 13 bp, C. elegans
ttttgttaattca

SEQ ID NO: 746058 - DNA, 13 bp, C. elegans
ttttgttacaatt

SEQ ID NO: 746059 - DNA, 13 bp, C. elegans
ttttgttagaaat

SEQ ID NO: 746060 - DNA, 13 bp, C. elegans
ttttgttataact

SEQ ID NO: 746061 - DNA, 13 bp, C. elegans
ttttgttatcaga

SEQ ID NO: 746062 - DNA, 13 bp, C. elegans
ttttgttcaaaaa

SEQ ID NO: 746063 - DNA, 14 bp, C. elegans
ttttgttcaaaaat

SEQ ID NO: 746064 - DNA, 13 bp, C. elegans
ttttgttcaaata

SEQ ID NO: 746065 - DNA, 13 bp, C. elegans
ttttgttcaagtt

SEQ ID NO: 746066 - DNA, 13 bp, C. elegans
ttttgttcaatct

SEQ ID NO: 746067 - DNA, 13 bp, C. elegans
ttttgttcaatta

SEQ ID NO: 746068 - DNA, 13 bp, C. elegans
ttttgttcaattc

SEQ ID NO: 746069 - DNA, 13 bp, C. elegans
ttttgttcacaaa

SEQ ID NO: 746070 - DNA, 13 bp, C. elegans
ttttgttcagaat

SEQ ID NO: 746071 - DNA, 13 bp, C. elegans
ttttgttcagttc

SEQ ID NO: 746072 - DNA, 13 bp, C. elegans
ttttgttcataaa

SEQ ID NO: 746073 - DNA, 13 bp, C. elegans
ttttgttccaaaa

SEQ ID NO: 746074 - DNA, 13 bp, C. elegans
ttttgttccaaat

SEQ ID NO: 746075 - DNA, 15 bp, C. elegans
ttttgttccaaattt

SEQ ID NO: 746076 - DNA, 13 bp, C. elegans
ttttgttccagaa

SEQ ID NO: 746077 - DNA, 13 bp, C. elegans
ttttgttcgaaaa

SEQ ID NO: 746078 - DNA, 13 bp, C. elegans
ttttgttcgataa

SEQ ID NO: 746079 - DNA, 13 bp, C. elegans
ttttgttctaaaa

SEQ ID NO: 746080 - DNA, 13 bp, C. elegans
ttttgttctaata

SEQ ID NO: 746081 - DNA, 13 bp, C. elegans
ttttgttctggaa

SEQ ID NO: 746082 - DNA, 13 bp, C. elegans
ttttgttcttgaa

SEQ ID NO: 746083 - DNA, 13 bp, C. elegans
ttttgttgaaaca

SEQ ID NO: 746084 - DNA, 13 bp, C. elegans
ttttgttgaaaga

SEQ ID NO: 746085 - DNA, 13 bp, C. elegans
ttttgttgaataa

SEQ ID NO: 746086 - DNA, 13 bp, C. elegans
ttttgttgaatac

SEQ ID NO: 746087 - DNA, 13 bp, C. elegans
ttttgttgaattc

SEQ ID NO: 746088 - DNA, 13 bp, C. elegans
ttttgttgagaaa

SEQ ID NO: 746089 - DNA, 13 bp, C. elegans
ttttgttgataaa

SEQ ID NO: 746090 - DNA, 13 bp, C. elegans
ttttgttgatcaa

SEQ ID NO: 746091 - DNA, 13 bp, C. elegans
ttttgttgatcta

SEQ ID NO: 746092 - DNA, 13 bp, C. elegans
ttttgttgattca

SEQ ID NO: 746093 - DNA, 13 bp, C. elegans
ttttgttgcaaaa

SEQ ID NO: 746094 - DNA, 13 bp, C. elegans
ttttgttgctaat

SEQ ID NO: 746095 - DNA, 13 bp, C. elegans
ttttgttggaaaa

SEQ ID NO: 746096 - DNA, 13 bp, C. elegans
ttttgttggaaat

SEQ ID NO: 746097 - DNA, 13 bp, C. elegans
ttttgttggaaca

SEQ ID NO: 746098 - DNA, 13 bp, C. elegans
ttttgttggaaga

SEQ ID NO: 746099 - DNA, 13 bp, C. elegans
ttttgttgtaccc

SEQ ID NO: 746100 - DNA, 13 bp, C. elegans
ttttgttgtcaaa

SEQ ID NO: 746101 - DNA, 13 bp, C. elegans
ttttgttgtcaat

SEQ ID NO: 746102 - DNA, 13 bp, C. elegans
ttttgttgtctaa

SEQ ID NO: 746103 - DNA, 13 bp, C. elegans
ttttgttgttcga

SEQ ID NO: 746104 - DNA, 13 bp, C. elegans
ttttgttgttgca

SEQ ID NO: 746105 - DNA, 13 bp, C. elegans
ttttgtttaaaac

SEQ ID NO: 746106 - DNA, 13 bp, C. elegans
ttttgtttaaaag

SEQ ID NO: 746107 - DNA, 13 bp, C. elegans
ttttgtttaaatc

SEQ ID NO: 746108 - DNA, 18 bp, C. elegans
ttttgtttaccccacgta

SEQ ID NO: 746109 - DNA, 13 bp, C. elegans
ttttgtttcaaac

SEQ ID NO: 746110 - DNA, 13 bp, C. elegans
ttttgtttcaaat

SEQ ID NO: 746111 - DNA, 13 bp, C. elegans
ttttgtttcagaa

SEQ ID NO: 746112 - DNA, 13 bp, C. elegans
ttttgtttcagct

SEQ ID NO: 746113 - DNA, 13 bp, C. elegans
ttttgtttcatga

SEQ ID NO: 746114 - DNA, 13 bp, C. elegans
ttttgtttccatg

SEQ ID NO: 746115 - DNA, 13 bp, C. elegans
ttttgtttcgaaa

SEQ ID NO: 746116 - DNA, 13 bp, C. elegans
ttttgtttcggaa

SEQ ID NO: 746117 - DNA, 13 bp, C. elegans
ttttgtttctgaa

SEQ ID NO: 746118 - DNA, 13 bp, C. elegans
ttttgtttgcaac

SEQ ID NO: 746119 - DNA, 13 bp, C. elegans
ttttgtttgcaat

SEQ ID NO: 746120 - DNA, 13 bp, C. elegans
ttttgtttggaaa

SEQ ID NO: 746121 - DNA, 13 bp, C. elegans
ttttgttttacag

SEQ ID NO: 746122 - DNA, 13 bp, C. elegans
ttttgttttcaaa

SEQ ID NO: 746123 - DNA, 13 bp, C. elegans
ttttgttttcacg

SEQ ID NO: 746124 - DNA, 13 bp, C. elegans
ttttgttttccag

SEQ ID NO: 746125 - DNA, 13 bp, C. elegans
ttttgttttcgaa

SEQ ID NO: 746126 - DNA, 13 bp, C. elegans
ttttgttttgcaa

SEQ ID NO: 746127 - DNA, 13 bp, C. elegans
ttttgttttgcac

SEQ ID NO: 746128 - DNA, 13 bp, C. elegans
tttttaaaaaacg

SEQ ID NO: 746129 - DNA, 13 bp, C. elegans
tttttaaaactca

SEQ ID NO: 746130 - DNA, 13 bp, C. elegans
tttttaaaactct

SEQ ID NO: 746131 - DNA, 13 bp, C. elegans
tttttaaaacttc

SEQ ID NO: 746132 - DNA, 13 bp, C. elegans
tttttaaaagcat

SEQ ID NO: 746133 - DNA, 13 bp, C. elegans
tttttaaaagctt

SEQ ID NO: 746134 - DNA, 13 bp, C. elegans
tttttaaaattgg

SEQ ID NO: 746135 - DNA, 13 bp, C. elegans
tttttaaacatgt

SEQ ID NO: 746136 - DNA, 13 bp, C. elegans
tttttaaaccaat

SEQ ID NO: 746137 - DNA, 13 bp, C. elegans
tttttaaacctca

SEQ ID NO: 746138 - DNA, 13 bp, C. elegans
tttttaaactgag

SEQ ID NO: 746139 - DNA, 13 bp, C. elegans
tttttaaagccta

SEQ ID NO: 746140 - DNA, 13 bp, C. elegans
tttttaaagcttg

SEQ ID NO: 746141 - DNA, 13 bp, C. elegans
tttttaaaggaaa

SEQ ID NO: 746142 - DNA, 13 bp, C. elegans
tttttaaaggtat

SEQ ID NO: 746143 - DNA, 13 bp, C. elegans
tttttaaagtcaa

SEQ ID NO: 746144 - DNA, 13 bp, C. elegans
tttttaaagtcta

SEQ ID NO: 746145 - DNA, 13 bp, C. elegans
tttttaaagtgaa

SEQ ID NO: 746146 - DNA, 13 bp, C. elegans
tttttaaagtgca

SEQ ID NO: 746147 - DNA, 13 bp, C. elegans
tttttaaagttcc

SEQ ID NO: 746148 - DNA, 13 bp, C. elegans
tttttaaatatcg

SEQ ID NO: 746149 - DNA, 13 bp, C. elegans
tttttaaatccat

SEQ ID NO: 746150 - DNA, 13 bp, C. elegans
tttttaaatctag

SEQ ID NO: 746151 - DNA, 13 bp, C. elegans
tttttaaatgaga

SEQ ID NO: 746152 - DNA, 13 bp, C. elegans
tttttaaatgcac

SEQ ID NO: 746153 - DNA, 13 bp, C. elegans
tttttaaatgtac

SEQ ID NO: 746154 - DNA, 13 bp, C. elegans
tttttaaatgtga

SEQ ID NO: 746155 - DNA, 13 bp, C. elegans
tttttaaattacc

SEQ ID NO: 746156 - DNA, 13 bp, C. elegans
tttttaaattcgc

SEQ ID NO: 746157 - DNA, 13 bp, C. elegans
tttttaacacatt

SEQ ID NO: 746158 - DNA, 13 bp, C. elegans
tttttaacagaaa

SEQ ID NO: 746159 - DNA, 13 bp, C. elegans
tttttaacagttt

SEQ ID NO: 746160 - DNA, 13 bp, C. elegans
tttttaacatgtt

SEQ ID NO: 746161 - DNA, 13 bp, C. elegans
tttttaacggaaa

SEQ ID NO: 746162 - DNA, 13 bp, C. elegans
tttttaagacaat

SEQ ID NO: 746163 - DNA, 13 bp, C. elegans
tttttaagattct

SEQ ID NO: 746164 - DNA, 13 bp, C. elegans
tttttaagctgtt

SEQ ID NO: 746165 - DNA, 13 bp, C. elegans
tttttaagctttc

SEQ ID NO: 746166 - DNA, 13 bp, C. elegans
tttttaaggaaaa

SEQ ID NO: 746167 - DNA, 13 bp, C. elegans
tttttaagtcaaa

SEQ ID NO: 746168 - DNA, 13 bp, C. elegans
tttttaataatcc

SEQ ID NO: 746169 - DNA, 13 bp, C. elegans
tttttaatagagt

SEQ ID NO: 746170 - DNA, 13 bp, C. elegans
tttttaatatgct

SEQ ID NO: 746171 - DNA, 13 bp, C. elegans
tttttaatcaaca

SEQ ID NO: 746172 - DNA, 13 bp, C. elegans
tttttaatcaagt

SEQ ID NO: 746173 - DNA, 13 bp, C. elegans
tttttaatcagtt

SEQ ID NO: 746174 - DNA, 13 bp, C. elegans
tttttaatccaaa

SEQ ID NO: 746175 - DNA, 13 bp, C. elegans
tttttaatcgatt

SEQ ID NO: 746176 - DNA, 13 bp, C. elegans
tttttaatgagaa

SEQ ID NO: 746177 - DNA, 13 bp, C. elegans
tttttaatgatct

SEQ ID NO: 746178 - DNA, 13 bp, C. elegans
tttttaatgatga

SEQ ID NO: 746179 - DNA, 13 bp, C. elegans
tttttaatggaaa

SEQ ID NO: 746180 - DNA, 13 bp, C. elegans
tttttaatgggaa

SEQ ID NO: 746181 - DNA, 13 bp, C. elegans
tttttaattcatg

SEQ ID NO: 746182 - DNA, 13 bp, C. elegans
tttttaattccgg

SEQ ID NO: 746183 - DNA, 13 bp, C. elegans
tttttaattcgca

SEQ ID NO: 746184 - DNA, 13 bp, C. elegans
tttttaattctag

SEQ ID NO: 746185 - DNA, 13 bp, C. elegans
tttttaattgcaa

SEQ ID NO: 746186 - DNA, 13 bp, C. elegans
tttttaattgtca

SEQ ID NO: 746187 - DNA, 13 bp, C. elegans
tttttacaaacta

SEQ ID NO: 746188 - DNA, 13 bp, C. elegans
tttttacaaagtt

SEQ ID NO: 746189 - DNA, 13 bp, C. elegans
tttttacaacttc

SEQ ID NO: 746190 - DNA, 13 bp, C. elegans
tttttacaagttt

SEQ ID NO: 746191 - DNA, 13 bp, C. elegans
tttttacaataac

SEQ ID NO: 746192 - DNA, 13 bp, C. elegans
tttttacaattac

SEQ ID NO: 746193 - DNA, 13 bp, C. elegans
tttttacacccaa

SEQ ID NO: 746194 - DNA, 13 bp, C. elegans
tttttacagaaaa

SEQ ID NO: 746195 - DNA, 13 bp, C. elegans
tttttacagatct

SEQ ID NO: 746196 - DNA, 13 bp, C. elegans
tttttacagcatt

SEQ ID NO: 746197 - DNA, 13 bp, C. elegans
tttttacattgta

SEQ ID NO: 746198 - DNA, 13 bp, C. elegans
tttttaccagttt

SEQ ID NO: 746199 - DNA, 13 bp, C. elegans
tttttaccccaaa

SEQ ID NO: 746200 - DNA, 13 bp, C. elegans
tttttacgagttt

SEQ ID NO: 746201 - DNA, 13 bp, C. elegans
tttttacggaaaa

SEQ ID NO: 746202 - DNA, 13 bp, C. elegans
tttttactatgat

SEQ ID NO: 746203 - DNA, 13 bp, C. elegans
tttttactcaaaa

SEQ ID NO: 746204 - DNA, 13 bp, C. elegans
tttttactcgatt

SEQ ID NO: 746205 - DNA, 13 bp, C. elegans
tttttactgaaaa

SEQ ID NO: 746206 - DNA, 13 bp, C. elegans
tttttactgacaa

SEQ ID NO: 746207 - DNA, 13 bp, C. elegans
tttttactggaat

SEQ ID NO: 746208 - DNA, 13 bp, C. elegans
tttttactgtcaa

SEQ ID NO: 746209 - DNA, 13 bp, C. elegans
tttttacttcaaa

SEQ ID NO: 746210 - DNA, 13 bp, C. elegans
tttttacttggaa

SEQ ID NO: 746211 - DNA, 13 bp, C. elegans
tttttagaaaact

SEQ ID NO: 746212 - DNA, 13 bp, C. elegans
tttttagaaagct

SEQ ID NO: 746213 - DNA, 13 bp, C. elegans
tttttagaaatga

SEQ ID NO: 746214 - DNA, 13 bp, C. elegans
tttttagaagaaa

SEQ ID NO: 746215 - DNA, 13 bp, C. elegans
tttttagacattt

SEQ ID NO: 746216 - DNA, 13 bp, C. elegans
tttttagacttta

SEQ ID NO: 746217 - DNA, 13 bp, C. elegans
tttttagagatat

SEQ ID NO: 746218 - DNA, 13 bp, C. elegans
tttttagagtaaa

SEQ ID NO: 746219 - DNA, 13 bp, C. elegans
tttttagatgttc

SEQ ID NO: 746220 - DNA, 13 bp, C. elegans
tttttagcaaaaa

SEQ ID NO: 746221 - DNA, 13 bp, C. elegans
tttttagcataaa

SEQ ID NO: 746222 - DNA, 13 bp, C. elegans
tttttagcatatt

SEQ ID NO: 746223 - DNA, 13 bp, C. elegans
tttttagctcaat

SEQ ID NO: 746224 - DNA, 13 bp, C. elegans
tttttaggcattt

SEQ ID NO: 746225 - DNA, 13 bp, C. elegans
tttttaggcgaaa

SEQ ID NO: 746226 - DNA, 13 bp, C. elegans
tttttaggggaaa

SEQ ID NO: 746227 - DNA, 13 bp, C. elegans
tttttaggtgaaa

SEQ ID NO: 746228 - DNA, 13 bp, C. elegans
tttttagtaaaag

SEQ ID NO: 746229 - DNA, 13 bp, C. elegans
tttttagtcaaat

SEQ ID NO: 746230 - DNA, 13 bp, C. elegans
tttttagtcaatt

SEQ ID NO: 746231 - DNA, 13 bp, C. elegans
tttttagtcttca

SEQ ID NO: 746232 - DNA, 13 bp, C. elegans
tttttagtgaaaa

SEQ ID NO: 746233 - DNA, 13 bp, C. elegans
tttttagtgaaac

SEQ ID NO: 746234 - DNA, 13 bp, C. elegans
tttttagtgaact

SEQ ID NO: 746235 - DNA, 13 bp, C. elegans
tttttagtgataa

SEQ ID NO: 746236 - DNA, 13 bp, C. elegans
tttttagtgctct

SEQ ID NO: 746237 - DNA, 13 bp, C. elegans
tttttagtggaaa

SEQ ID NO: 746238 - DNA, 13 bp, C. elegans
tttttagtgttca

SEQ ID NO: 746239 - DNA, 13 bp, C. elegans
tttttagttcaaa

SEQ ID NO: 746240 - DNA, 13 bp, C. elegans
tttttagttgaca

SEQ ID NO: 746241 - DNA, 13 bp, C. elegans
tttttagtttcga

SEQ ID NO: 746242 - DNA, 13 bp, C. elegans
tttttataaatgc

SEQ ID NO: 746243 - DNA, 13 bp, C. elegans
tttttataagttc

SEQ ID NO: 746244 - DNA, 13 bp, C. elegans
tttttataattgc

SEQ ID NO: 746245 - DNA, 13 bp, C. elegans
tttttatacaaca

SEQ ID NO: 746246 - DNA, 13 bp, C. elegans
tttttatattcga

SEQ ID NO: 746247 - DNA, 13 bp, C. elegans
tttttatcaacaa

SEQ ID NO: 746248 - DNA, 13 bp, C. elegans
tttttatcacaaa

SEQ ID NO: 746249 - DNA, 13 bp, C. elegans
tttttatcagatt

SEQ ID NO: 746250 - DNA, 13 bp, C. elegans
tttttatcagttc

SEQ ID NO: 746251 - DNA, 13 bp, C. elegans
tttttatcgatta

SEQ ID NO: 746252 - DNA, 13 bp, C. elegans
tttttatctgaat

SEQ ID NO: 746253 - DNA, 13 bp, C. elegans
tttttatctgcaa

SEQ ID NO: 746254 - DNA, 13 bp, C. elegans
tttttatgaaaag

SEQ ID NO: 746255 - DNA, 13 bp, C. elegans
tttttatgaagaa

SEQ ID NO: 746256 - DNA, 13 bp, C. elegans
tttttatgagaaa

SEQ ID NO: 746257 - DNA, 13 bp, C. elegans
tttttatgcaatt

SEQ ID NO: 746258 - DNA, 13 bp, C. elegans
tttttatggcaat

SEQ ID NO: 746259 - DNA, 13 bp, C. elegans
tttttatgtcaaa

SEQ ID NO: 746260 - DNA, 13 bp, C. elegans
tttttatgtgaaa

SEQ ID NO: 746261 - DNA, 14 bp, C. elegans
tttttatgtgaaaa

SEQ ID NO: 746262 - DNA, 13 bp, C. elegans
tttttatgtgcaa

SEQ ID NO: 746263 - DNA, 13 bp, C. elegans
tttttattcaaac

SEQ ID NO: 746264 - DNA, 13 bp, C. elegans
tttttattcaaga

SEQ ID NO: 746265 - DNA, 13 bp, C. elegans
tttttattcactg

SEQ ID NO: 746266 - DNA, 13 bp, C. elegans
tttttattcagaa

SEQ ID NO: 746267 - DNA, 13 bp, C. elegans
tttttattccaga

SEQ ID NO: 746268 - DNA, 13 bp, C. elegans
tttttattcggaa

SEQ ID NO: 746269 - DNA, 13 bp, C. elegans
tttttattctgca

SEQ ID NO: 746270 - DNA, 13 bp, C. elegans
tttttattgccat

SEQ ID NO: 746271 - DNA, 13 bp, C. elegans
tttttattgctga

SEQ ID NO: 746272 - DNA, 13 bp, C. elegans
tttttattgtcaa

SEQ ID NO: 746273 - DNA, 13 bp, C. elegans
tttttatttcaga

SEQ ID NO: 746274 - DNA, 13 bp, C. elegans
tttttatttgcaa

SEQ ID NO: 746275 - DNA, 13 bp, C. elegans
tttttcaaaaact

SEQ ID NO: 746276 - DNA, 13 bp, C. elegans
tttttcaaaaagt

SEQ ID NO: 746277 - DNA, 13 bp, C. elegans
tttttcaaaaatc

SEQ ID NO: 746278 - DNA, 13 bp, C. elegans
tttttcaaaacaa

SEQ ID NO: 746279 - DNA, 13 bp, C. elegans
tttttcaaaacca

SEQ ID NO: 746280 - DNA, 13 bp, C. elegans
tttttcaaaacta

SEQ ID NO: 746281 - DNA, 13 bp, C. elegans
tttttcaaaactt

SEQ ID NO: 746282 - DNA, 13 bp, C. elegans
tttttcaaaatag

SEQ ID NO: 746283 - DNA, 13 bp, C. elegans
tttttcaaaatca

SEQ ID NO: 746284 - DNA, 13 bp, C. elegans
tttttcaaaatct

SEQ ID NO: 746285 - DNA, 13 bp, C. elegans
tttttcaaaatgc

SEQ ID NO: 746286 - DNA, 13 bp, C. elegans
tttttcaaaattc

SEQ ID NO: 746287 - DNA, 14 bp, C. elegans
tttttcaaaattct

SEQ ID NO: 746288 - DNA, 14 bp, C. elegans
tttttcaaacaaat

SEQ ID NO: 746289 - DNA, 13 bp, C. elegans
tttttcaaacacc

SEQ ID NO: 746290 - DNA, 13 bp, C. elegans
tttttcaaacatt

SEQ ID NO: 746291 - DNA, 13 bp, C. elegans
tttttcaaaccca

SEQ ID NO: 746292 - DNA, 13 bp, C. elegans
tttttcaaacctt

SEQ ID NO: 746293 - DNA, 13 bp, C. elegans
tttttcaaactag

SEQ ID NO: 746294 - DNA, 13 bp, C. elegans
tttttcaaagaaa

SEQ ID NO: 746295 - DNA, 13 bp, C. elegans
tttttcaaagaat

SEQ ID NO: 746296 - DNA, 13 bp, C. elegans
tttttcaaagcca

SEQ ID NO: 746297 - DNA, 13 bp, C. elegans
tttttcaaagcta

SEQ ID NO: 746298 - DNA, 13 bp, C. elegans
tttttcaaagtaa

SEQ ID NO: 746299 - DNA, 13 bp, C. elegans
tttttcaaagtta

SEQ ID NO: 746300 - DNA, 13 bp, C. elegans
tttttcaaagttc

SEQ ID NO: 746301 - DNA, 13 bp, C. elegans
tttttcaaagttt

SEQ ID NO: 746302 - DNA, 13 bp, C. elegans
tttttcaaatcta

SEQ ID NO: 746303 - DNA, 13 bp, C. elegans
tttttcaaatgat

SEQ ID NO: 746304 - DNA, 13 bp, C. elegans
tttttcaaatgtt

SEQ ID NO: 746305 - DNA, 14 bp, C. elegans
tttttcaaattcaa

SEQ ID NO: 746306 - DNA, 14 bp, C. elegans
tttttcaacaaaat

SEQ ID NO: 746307 - DNA, 13 bp, C. elegans
tttttcaacacaa

SEQ ID NO: 746308 - DNA, 13 bp, C. elegans
tttttcaacactt

SEQ ID NO: 746309 - DNA, 13 bp, C. elegans
tttttcaacatct

SEQ ID NO: 746310 - DNA, 13 bp, C. elegans
tttttcaaccagt

SEQ ID NO: 746311 - DNA, 13 bp, C. elegans
tttttcaacgatt

SEQ ID NO: 746312 - DNA, 13 bp, C. elegans
tttttcaactaat

SEQ ID NO: 746313 - DNA, 13 bp, C. elegans
tttttcaagaaaa

SEQ ID NO: 746314 - DNA, 13 bp, C. elegans
tttttcaagaaat

SEQ ID NO: 746315 - DNA, 13 bp, C. elegans
tttttcaagaatt

SEQ ID NO: 746316 - DNA, 13 bp, C. elegans
tttttcaagagtt

SEQ ID NO: 746317 - DNA, 13 bp, C. elegans
tttttcaagattt

SEQ ID NO: 746318 - DNA, 13 bp, C. elegans
tttttcaagctca

SEQ ID NO: 746319 - DNA, 14 bp, C. elegans
tttttcaagctttt

SEQ ID NO: 746320 - DNA, 13 bp, C. elegans
tttttcaaggttt

SEQ ID NO: 746321 - DNA, 13 bp, C. elegans
tttttcaagtaaa

SEQ ID NO: 746322 - DNA, 13 bp, C. elegans
tttttcaagtact

SEQ ID NO: 746323 - DNA, 13 bp, C. elegans
tttttcaagtata

SEQ ID NO: 746324 - DNA, 13 bp, C. elegans
tttttcaagtatc

SEQ ID NO: 746325 - DNA, 13 bp, C. elegans
tttttcaagtctt

SEQ ID NO: 746326 - DNA, 13 bp, C. elegans
tttttcaagttct

SEQ ID NO: 746327 - DNA, 13 bp, C. elegans
tttttcaagttta

SEQ ID NO: 746328 - DNA, 13 bp, C. elegans
tttttcaagtttc

SEQ ID NO: 746329 - DNA, 13 bp, C. elegans
tttttcaataaac

SEQ ID NO: 746330 - DNA, 13 bp, C. elegans
tttttcaataaag

SEQ ID NO: 746331 - DNA, 13 bp, C. elegans
tttttcaatacta

SEQ ID NO: 746332 - DNA, 13 bp, C. elegans
tttttcaatagtt

SEQ ID NO: 746333 - DNA, 13 bp, C. elegans
tttttcaatatca

SEQ ID NO: 746334 - DNA, 13 bp, C. elegans
tttttcaatatga

SEQ ID NO: 746335 - DNA, 13 bp, C. elegans
tttttcaatcaaa

SEQ ID NO: 746336 - DNA, 13 bp, C. elegans
tttttcaatcaat

SEQ ID NO: 746337 - DNA, 13 bp, C. elegans
tttttcaatcact

SEQ ID NO: 746338 - DNA, 13 bp, C. elegans
tttttcaatcgtt

SEQ ID NO: 746339 - DNA, 13 bp, C. elegans
tttttcaatctaa

SEQ ID NO: 746340 - DNA, 13 bp, C. elegans
tttttcaatgaca

SEQ ID NO: 746341 - DNA, 13 bp, C. elegans
tttttcaatgata

SEQ ID NO: 746342 - DNA, 13 bp, C. elegans
tttttcaatgatt

SEQ ID NO: 746343 - DNA, 13 bp, C. elegans
tttttcaatggaa

SEQ ID NO: 746344 - DNA, 13 bp, C. elegans
tttttcaatggta

SEQ ID NO: 746345 - DNA, 13 bp, C. elegans
tttttcaattaag

SEQ ID NO: 746346 - DNA, 13 bp, C. elegans
tttttcaattaga

SEQ ID NO: 746347 - DNA, 13 bp, C. elegans
tttttcaattagt

SEQ ID NO: 746348 - DNA, 13 bp, C. elegans
tttttcaattgaa

SEQ ID NO: 746349 - DNA, 13 bp, C. elegans
tttttcaattgac

SEQ ID NO: 746350 - DNA, 13 bp, C. elegans
tttttcaattgtg

SEQ ID NO: 746351 - DNA, 13 bp, C. elegans
tttttcaatttcg

SEQ ID NO: 746352 - DNA, 13 bp, C. elegans
tttttcaatttga

SEQ ID NO: 746353 - DNA, 13 bp, C. elegans
tttttcacaagtt

SEQ ID NO: 746354 - DNA, 13 bp, C. elegans
tttttcacacaaa

SEQ ID NO: 746355 - DNA, 13 bp, C. elegans
tttttcacagaaa

SEQ ID NO: 746356 - DNA, 13 bp, C. elegans
tttttcacagaac

SEQ ID NO: 746357 - DNA, 13 bp, C. elegans
tttttcacataaa

SEQ ID NO: 746358 - DNA, 13 bp, C. elegans
tttttcacatgtt

SEQ ID NO: 746359 - DNA, 13 bp, C. elegans
tttttcacattaa

SEQ ID NO: 746360 - DNA, 13 bp, C. elegans
tttttcacattca

SEQ ID NO: 746361 - DNA, 13 bp, C. elegans
tttttcacattga

SEQ ID NO: 746362 - DNA, 13 bp, C. elegans
tttttcaccaatt

SEQ ID NO: 746363 - DNA, 13 bp, C. elegans
tttttcacccaat

SEQ ID NO: 746364 - DNA, 13 bp, C. elegans
tttttcaccgaaa

SEQ ID NO: 746365 - DNA, 13 bp, C. elegans
tttttcacgaaaa

SEQ ID NO: 746366 - DNA, 13 bp, C. elegans
tttttcacggttt

SEQ ID NO: 746367 - DNA, 13 bp, C. elegans
tttttcactacaa

SEQ ID NO: 746368 - DNA, 13 bp, C. elegans
tttttcactcaaa

SEQ ID NO: 746369 - DNA, 13 bp, C. elegans
tttttcactccaa

SEQ ID NO: 746370 - DNA, 13 bp, C. elegans
tttttcactcgaa

SEQ ID NO: 746371 - DNA, 13 bp, C. elegans
tttttcactgcaa

SEQ ID NO: 746372 - DNA, 13 bp, C. elegans
tttttcacttgga

SEQ ID NO: 746373 - DNA, 14 bp, C. elegans
tttttcagaaaaat

SEQ ID NO: 746374 - DNA, 13 bp, C. elegans
tttttcagaaata

SEQ ID NO: 746375 - DNA, 13 bp, C. elegans
tttttcagaacgt

SEQ ID NO: 746376 - DNA, 13 bp, C. elegans
tttttcagaactt

SEQ ID NO: 746377 - DNA, 13 bp, C. elegans
tttttcagaagat

SEQ ID NO: 746378 - DNA, 13 bp, C. elegans
tttttcagaagtt

SEQ ID NO: 746379 - DNA, 13 bp, C. elegans
tttttcagaataa

SEQ ID NO: 746380 - DNA, 13 bp, C. elegans
tttttcagaatta

SEQ ID NO: 746381 - DNA, 13 bp, C. elegans
tttttcagaattc

SEQ ID NO: 746382 - DNA, 13 bp, C. elegans
tttttcagagaat

SEQ ID NO: 746383 - DNA, 13 bp, C. elegans
tttttcagatctc

SEQ ID NO: 746384 - DNA, 13 bp, C. elegans
tttttcagattct

SEQ ID NO: 746385 - DNA, 13 bp, C. elegans
tttttcagattga

SEQ ID NO: 746386 - DNA, 13 bp, C. elegans
tttttcagcaaaa

SEQ ID NO: 746387 - DNA, 13 bp, C. elegans
tttttcagcattt

SEQ ID NO: 746388 - DNA, 13 bp, C. elegans
tttttcagccgaa

SEQ ID NO: 746389 - DNA, 13 bp, C. elegans
tttttcagcgttt

SEQ ID NO: 746390 - DNA, 13 bp, C. elegans
tttttcagctatt

SEQ ID NO: 746391 - DNA, 13 bp, C. elegans
tttttcagctcaa

SEQ ID NO: 746392 - DNA, 13 bp, C. elegans
tttttcaggaaaa

SEQ ID NO: 746393 - DNA, 13 bp, C. elegans
tttttcaggattt

SEQ ID NO: 746394 - DNA, 13 bp, C. elegans
tttttcagggttt

SEQ ID NO: 746395 - DNA, 13 bp, C. elegans
tttttcagtaaaa

SEQ ID NO: 746396 - DNA, 13 bp, C. elegans
tttttcagtaaat

SEQ ID NO: 746397 - DNA, 13 bp, C. elegans
tttttcagtaatc

SEQ ID NO: 746398 - DNA, 13 bp, C. elegans
tttttcagtacat

SEQ ID NO: 746399 - DNA, 13 bp, C. elegans
tttttcagtgatt

SEQ ID NO: 746400 - DNA, 13 bp, C. elegans
tttttcagtgtca

SEQ ID NO: 746401 - DNA, 13 bp, C. elegans
tttttcagttaaa

SEQ ID NO: 746402 - DNA, 14 bp, C. elegans
tttttcagttcaat

SEQ ID NO: 746403 - DNA, 13 bp, C. elegans
tttttcataaact

SEQ ID NO: 746404 - DNA, 13 bp, C. elegans
tttttcatcaaaa

SEQ ID NO: 746405 - DNA, 13 bp, C. elegans
tttttcatcaata

SEQ ID NO: 746406 - DNA, 13 bp, C. elegans
tttttcatcacaa

SEQ ID NO: 746407 - DNA, 14 bp, C. elegans
tttttcatgaaaat

SEQ ID NO: 746408 - DNA, 13 bp, C. elegans
tttttcatgaata

SEQ ID NO: 746409 - DNA, 13 bp, C. elegans
tttttcatgataa

SEQ ID NO: 746410 - DNA, 13 bp, C. elegans
tttttcatggcaa

SEQ ID NO: 746411 - DNA, 13 bp, C. elegans
tttttcatgtcaa

SEQ ID NO: 746412 - DNA, 13 bp, C. elegans
tttttcatgttca

SEQ ID NO: 746413 - DNA, 13 bp, C. elegans
tttttcattagaa

SEQ ID NO: 746414 - DNA, 13 bp, C. elegans
tttttcattcaaa

SEQ ID NO: 746415 - DNA, 13 bp, C. elegans
tttttcattcaca

SEQ ID NO: 746416 - DNA, 13 bp, C. elegans
tttttcattgcaa

SEQ ID NO: 746417 - DNA, 13 bp, C. elegans
tttttcattggaa

SEQ ID NO: 746418 - DNA, 13 bp, C. elegans
tttttcatttcag

SEQ ID NO: 746419 - DNA, 13 bp, C. elegans
tttttcatttgaa

SEQ ID NO: 746420 - DNA, 13 bp, C. elegans
tttttccaaaaaa

SEQ ID NO: 746421 - DNA, 13 bp, C. elegans
tttttccaaaaac

SEQ ID NO: 746422 - DNA, 13 bp, C. elegans
tttttccaaaact

SEQ ID NO: 746423 - DNA, 13 bp, C. elegans
tttttccaaaaga

SEQ ID NO: 746424 - DNA, 13 bp, C. elegans
tttttccaaaagg

SEQ ID NO: 746425 - DNA, 13 bp, C. elegans
tttttccaaaagt

SEQ ID NO: 746426 - DNA, 13 bp, C. elegans
tttttccaaatct

SEQ ID NO: 746427 - DNA, 13 bp, C. elegans
tttttccaaattg

SEQ ID NO: 746428 - DNA, 14 bp, C. elegans
tttttccaacaaaa

SEQ ID NO: 746429 - DNA, 13 bp, C. elegans
tttttccaacaac

SEQ ID NO: 746430 - DNA, 13 bp, C. elegans
tttttccaatgta

SEQ ID NO: 746431 - DNA, 13 bp, C. elegans
tttttccacactt

SEQ ID NO: 746432 - DNA, 13 bp, C. elegans
tttttccacagaa

SEQ ID NO: 746433 - DNA, 13 bp, C. elegans
tttttccacattc

SEQ ID NO: 746434 - DNA, 13 bp, C. elegans
tttttccaccaaa

SEQ ID NO: 746435 - DNA, 13 bp, C. elegans
tttttccacggag

SEQ ID NO: 746436 - DNA, 13 bp, C. elegans
tttttccactaaa

SEQ ID NO: 746437 - DNA, 13 bp, C. elegans
tttttccagaaaa

SEQ ID NO: 746438 - DNA, 13 bp, C. elegans
tttttccagattt

SEQ ID NO: 746439 - DNA, 13 bp, C. elegans
tttttccagctaa

SEQ ID NO: 746440 - DNA, 13 bp, C. elegans
tttttccataaat

SEQ ID NO: 746441 - DNA, 13 bp, C. elegans
tttttccataata

SEQ ID NO: 746442 - DNA, 13 bp, C. elegans
tttttccatcaat

SEQ ID NO: 746443 - DNA, 13 bp, C. elegans
tttttccatgttc

SEQ ID NO: 746444 - DNA, 13 bp, C. elegans
tttttccattaaa

SEQ ID NO: 746445 - DNA, 13 bp, C. elegans
tttttccattcaa

SEQ ID NO: 746446 - DNA, 13 bp, C. elegans
tttttccattgaa

SEQ ID NO: 746447 - DNA, 13 bp, C. elegans
tttttccatttgc

SEQ ID NO: 746448 - DNA, 13 bp, C. elegans
tttttcccaaaaa

SEQ ID NO: 746449 - DNA, 13 bp, C. elegans
tttttcccaaaac

SEQ ID NO: 746450 - DNA, 13 bp, C. elegans
tttttcccacatt

SEQ ID NO: 746451 - DNA, 13 bp, C. elegans
tttttcccactga

SEQ ID NO: 746452 - DNA, 13 bp, C. elegans
tttttcccatcat

SEQ ID NO: 746453 - DNA, 13 bp, C. elegans
tttttccccccaa

SEQ ID NO: 746454 - DNA, 13 bp, C. elegans
tttttcccccgaa

SEQ ID NO: 746455 - DNA, 13 bp, C. elegans
tttttccccggaa

SEQ ID NO: 746456 - DNA, 13 bp, C. elegans
tttttcccgccat

SEQ ID NO: 746457 - DNA, 13 bp, C. elegans
tttttccgaaaaa

SEQ ID NO: 746458 - DNA, 13 bp, C. elegans
tttttccgaaagt

SEQ ID NO: 746459 - DNA, 13 bp, C. elegans
tttttccgaaata

SEQ ID NO: 746460 - DNA, 13 bp, C. elegans
tttttccgaattt

SEQ ID NO: 746461 - DNA, 13 bp, C. elegans
tttttccgacaat

SEQ ID NO: 746462 - DNA, 13 bp, C. elegans
tttttccgagttt

SEQ ID NO: 746463 - DNA, 13 bp, C. elegans
tttttccgataat

SEQ ID NO: 746464 - DNA, 13 bp, C. elegans
tttttccgccaaa

SEQ ID NO: 746465 - DNA, 13 bp, C. elegans
tttttccgccgga

SEQ ID NO: 746466 - DNA, 13 bp, C. elegans
tttttccgctgaa

SEQ ID NO: 746467 - DNA, 13 bp, C. elegans
tttttccggattt

SEQ ID NO: 746468 - DNA, 13 bp, C. elegans
tttttccggcaaa

SEQ ID NO: 746469 - DNA, 13 bp, C. elegans
tttttccgtgccg

SEQ ID NO: 746470 - DNA, 13 bp, C. elegans
tttttcctaaaaa

SEQ ID NO: 746471 - DNA, 13 bp, C. elegans
tttttcctaataa

SEQ ID NO: 746472 - DNA, 13 bp, C. elegans
tttttcctcaaaa

SEQ ID NO: 746473 - DNA, 13 bp, C. elegans
tttttcctcgaat

SEQ ID NO: 746474 - DNA, 13 bp, C. elegans
tttttcctctgaa

SEQ ID NO: 746475 - DNA, 13 bp, C. elegans
tttttcctgatat

SEQ ID NO: 746476 - DNA, 13 bp, C. elegans
tttttcctgatca

SEQ ID NO: 746477 - DNA, 13 bp, C. elegans
tttttcctgcaaa

SEQ ID NO: 746478 - DNA, 13 bp, C. elegans
tttttcctgtaaa

SEQ ID NO: 746479 - DNA, 13 bp, C. elegans
tttttcctgtgaa

SEQ ID NO: 746480 - DNA, 13 bp, C. elegans
tttttccttcaaa

SEQ ID NO: 746481 - DNA, 13 bp, C. elegans
tttttcgaaaaac

SEQ ID NO: 746482 - DNA, 13 bp, C. elegans
tttttcgaaaagc

SEQ ID NO: 746483 - DNA, 13 bp, C. elegans
tttttcgaaaata

SEQ ID NO: 746484 - DNA, 13 bp, C. elegans
tttttcgaaaatc

SEQ ID NO: 746485 - DNA, 13 bp, C. elegans
tttttcgaaaatt

SEQ ID NO: 746486 - DNA, 13 bp, C. elegans
tttttcgaaacta

SEQ ID NO: 746487 - DNA, 13 bp, C. elegans
tttttcgaaagtt

SEQ ID NO: 746488 - DNA, 13 bp, C. elegans
tttttcgaaattc

SEQ ID NO: 746489 - DNA, 13 bp, C. elegans
tttttcgaaattg

SEQ ID NO: 746490 - DNA, 13 bp, C. elegans
tttttcgaaattt

SEQ ID NO: 746491 - DNA, 13 bp, C. elegans
tttttcgaacaat

SEQ ID NO: 746492 - DNA, 13 bp, C. elegans
tttttcgaacgaa

SEQ ID NO: 746493 - DNA, 13 bp, C. elegans
tttttcgaagaaa

SEQ ID NO: 746494 - DNA, 13 bp, C. elegans
tttttcgaagaat

SEQ ID NO: 746495 - DNA, 13 bp, C. elegans
tttttcgaatatt

SEQ ID NO: 746496 - DNA, 13 bp, C. elegans
tttttcgaatgaa

SEQ ID NO: 746497 - DNA, 13 bp, C. elegans
tttttcgaattta

SEQ ID NO: 746498 - DNA, 13 bp, C. elegans
tttttcgacaaaa

SEQ ID NO: 746499 - DNA, 13 bp, C. elegans
tttttcgacccaa

SEQ ID NO: 746500 - DNA, 13 bp, C. elegans
tttttcgacgaaa

SEQ ID NO: 746501 - DNA, 13 bp, C. elegans
tttttcgacttta

SEQ ID NO: 746502 - DNA, 13 bp, C. elegans
tttttcgagacgt

SEQ ID NO: 746503 - DNA, 13 bp, C. elegans
tttttcgagattt

SEQ ID NO: 746504 - DNA, 13 bp, C. elegans
tttttcgagtgaa

SEQ ID NO: 746505 - DNA, 13 bp, C. elegans
tttttcgagttga

SEQ ID NO: 746506 - DNA, 13 bp, C. elegans
tttttcgataaaa

SEQ ID NO: 746507 - DNA, 13 bp, C. elegans
tttttcgataata

SEQ ID NO: 746508 - DNA, 13 bp, C. elegans
tttttcgatgaaa

SEQ ID NO: 746509 - DNA, 13 bp, C. elegans
tttttcgattcaa

SEQ ID NO: 746510 - DNA, 13 bp, C. elegans
tttttcgatttaa

SEQ ID NO: 746511 - DNA, 13 bp, C. elegans
tttttcgatttgc

SEQ ID NO: 746512 - DNA, 13 bp, C. elegans
tttttcgcaaaaa

SEQ ID NO: 746513 - DNA, 13 bp, C. elegans
tttttcgcacatt

SEQ ID NO: 746514 - DNA, 13 bp, C. elegans
tttttcgcagaaa

SEQ ID NO: 746515 - DNA, 13 bp, C. elegans
tttttcgccaaaa

SEQ ID NO: 746516 - DNA, 13 bp, C. elegans
tttttcgcccaaa

SEQ ID NO: 746517 - DNA, 13 bp, C. elegans
tttttcgccgaat

SEQ ID NO: 746518 - DNA, 13 bp, C. elegans
tttttcgcctatt

SEQ ID NO: 746519 - DNA, 14 bp, C. elegans
tttttcgcgaaaat

SEQ ID NO: 746520 - DNA, 13 bp, C. elegans
tttttcgctggaa

SEQ ID NO: 746521 - DNA, 13 bp, C. elegans
tttttcggaaaag

SEQ ID NO: 746522 - DNA, 13 bp, C. elegans
tttttcggaaatt

SEQ ID NO: 746523 - DNA, 13 bp, C. elegans
tttttcggaacaa

SEQ ID NO: 746524 - DNA, 13 bp, C. elegans
tttttcggaatct

SEQ ID NO: 746525 - DNA, 13 bp, C. elegans
tttttcggaattc

SEQ ID NO: 746526 - DNA, 13 bp, C. elegans
tttttcggattta

SEQ ID NO: 746527 - DNA, 13 bp, C. elegans
tttttcggatttc

SEQ ID NO: 746528 - DNA, 13 bp, C. elegans
tttttcggcgatt

SEQ ID NO: 746529 - DNA, 13 bp, C. elegans
tttttcgggaatt

SEQ ID NO: 746530 - DNA, 13 bp, C. elegans
tttttcggtttca

SEQ ID NO: 746531 - DNA, 13 bp, C. elegans
tttttcgtaaaaa

SEQ ID NO: 746532 - DNA, 13 bp, C. elegans
tttttcgtaaaat

SEQ ID NO: 746533 - DNA, 13 bp, C. elegans
tttttcgtaacaa

SEQ ID NO: 746534 - DNA, 13 bp, C. elegans
tttttcgtagaaa

SEQ ID NO: 746535 - DNA, 13 bp, C. elegans
tttttcgtcaaaa

SEQ ID NO: 746536 - DNA, 13 bp, C. elegans
tttttcgtcatca

SEQ ID NO: 746537 - DNA, 13 bp, C. elegans
tttttcgtcgatt

SEQ ID NO: 746538 - DNA, 13 bp, C. elegans
tttttcgtgaaaa

SEQ ID NO: 746539 - DNA, 13 bp, C. elegans
tttttcgtggaaa

SEQ ID NO: 746540 - DNA, 24 bp, C. elegans
tttttcgtgtaacaatctattttt

SEQ ID NO: 746541 - DNA, 13 bp, C. elegans
tttttcgtgttga

SEQ ID NO: 746542 - DNA, 13 bp, C. elegans
tttttcgttccaa

SEQ ID NO: 746543 - DNA, 13 bp, C. elegans
tttttcgttgcaa

SEQ ID NO: 746544 - DNA, 13 bp, C. elegans
tttttcgttggaa

SEQ ID NO: 746545 - DNA, 13 bp, C. elegans
tttttcgtttcaa

SEQ ID NO: 746546 - DNA, 13 bp, C. elegans
tttttcgtttgaa

SEQ ID NO: 746547 - DNA, 13 bp, C. elegans
tttttctaaaaca

SEQ ID NO: 746548 - DNA, 13 bp, C. elegans
tttttctaaacaa

SEQ ID NO: 746549 - DNA, 13 bp, C. elegans
tttttctaaacta

SEQ ID NO: 746550 - DNA, 13 bp, C. elegans
tttttctaaatac

SEQ ID NO: 746551 - DNA, 13 bp, C. elegans
tttttctaaatga

SEQ ID NO: 746552 - DNA, 13 bp, C. elegans
tttttctaacaaa

SEQ ID NO: 746553 - DNA, 13 bp, C. elegans
tttttctaactgt

SEQ ID NO: 746554 - DNA, 13 bp, C. elegans
tttttctaagaaa

SEQ ID NO: 746555 - DNA, 13 bp, C. elegans
tttttctaatcaa

SEQ ID NO: 746556 - DNA, 13 bp, C. elegans
tttttctacaaaa

SEQ ID NO: 746557 - DNA, 13 bp, C. elegans
tttttctacaagt

SEQ ID NO: 746558 - DNA, 13 bp, C. elegans
tttttctacacaa

SEQ ID NO: 746559 - DNA, 13 bp, C. elegans
tttttctacatcg

SEQ ID NO: 746560 - DNA, 13 bp, C. elegans
tttttctacgaaa

SEQ ID NO: 746561 - DNA, 13 bp, C. elegans
tttttctactgat

SEQ ID NO: 746562 - DNA, 13 bp, C. elegans
tttttctaggcca

SEQ ID NO: 746563 - DNA, 13 bp, C. elegans
tttttctatacaa

SEQ ID NO: 746564 - DNA, 13 bp, C. elegans
tttttctatagaa

SEQ ID NO: 746565 - DNA, 13 bp, C. elegans
tttttctatgaaa

SEQ ID NO: 746566 - DNA, 13 bp, C. elegans
tttttctcaaaaa

SEQ ID NO: 746567 - DNA, 13 bp, C. elegans
tttttctcaaaca

SEQ ID NO: 746568 - DNA, 13 bp, C. elegans
tttttctcaaagt

SEQ ID NO: 746569 - DNA, 14 bp, C. elegans
tttttctcagaaat

SEQ ID NO: 746570 - DNA, 13 bp, C. elegans
tttttctcataca

SEQ ID NO: 746571 - DNA, 13 bp, C. elegans
tttttctcatcaa

SEQ ID NO: 746572 - DNA, 13 bp, C. elegans
tttttctccaata

SEQ ID NO: 746573 - DNA, 13 bp, C. elegans
tttttctccacat

SEQ ID NO: 746574 - DNA, 13 bp, C. elegans
tttttctccagat

SEQ ID NO: 746575 - DNA, 13 bp, C. elegans
tttttctccggaa

SEQ ID NO: 746576 - DNA, 13 bp, C. elegans
tttttctcctgaa

SEQ ID NO: 746577 - DNA, 13 bp, C. elegans
tttttctcgaaaa

SEQ ID NO: 746578 - DNA, 13 bp, C. elegans
tttttctcgaata

SEQ ID NO: 746579 - DNA, 13 bp, C. elegans
tttttctcgataa

SEQ ID NO: 746580 - DNA, 13 bp, C. elegans
tttttctcggcaa

SEQ ID NO: 746581 - DNA, 13 bp, C. elegans
tttttctcgggaa

SEQ ID NO: 746582 - DNA, 13 bp, C. elegans
tttttctcgtcac

SEQ ID NO: 746583 - DNA, 13 bp, C. elegans
tttttctcgtcta

SEQ ID NO: 746584 - DNA, 13 bp, C. elegans
tttttctcgttca

SEQ ID NO: 746585 - DNA, 13 bp, C. elegans
tttttctctaaaa

SEQ ID NO: 746586 - DNA, 13 bp, C. elegans
tttttctctagaa

SEQ ID NO: 746587 - DNA, 13 bp, C. elegans
tttttctctcaca

SEQ ID NO: 746588 - DNA, 13 bp, C. elegans
tttttctctccaa

SEQ ID NO: 746589 - DNA, 13 bp, C. elegans
tttttctctgaat

SEQ ID NO: 746590 - DNA, 13 bp, C. elegans
tttttctctgcaa

SEQ ID NO: 746591 - DNA, 13 bp, C. elegans
tttttctctgcat

SEQ ID NO: 746592 - DNA, 13 bp, C. elegans
tttttctgaaaac

SEQ ID NO: 746593 - DNA, 13 bp, C. elegans
tttttctgaaaca

SEQ ID NO: 746594 - DNA, 13 bp, C. elegans
tttttctgaaata

SEQ ID NO: 746595 - DNA, 13 bp, C. elegans
tttttctgaaatc

SEQ ID NO: 746596 - DNA, 13 bp, C. elegans
tttttctgaaatt

SEQ ID NO: 746597 - DNA, 13 bp, C. elegans
tttttctgaactt

SEQ ID NO: 746598 - DNA, 13 bp, C. elegans
tttttctgaagat

SEQ ID NO: 746599 - DNA, 13 bp, C. elegans
tttttctgaataa

SEQ ID NO: 746600 - DNA, 13 bp, C. elegans
tttttctgaatgt

SEQ ID NO: 746601 - DNA, 13 bp, C. elegans
tttttctgaattc

SEQ ID NO: 746602 - DNA, 13 bp, C. elegans
tttttctgagaaa

SEQ ID NO: 746603 - DNA, 13 bp, C. elegans
tttttctgagaga

SEQ ID NO: 746604 - DNA, 13 bp, C. elegans
tttttctgagcaa

SEQ ID NO: 746605 - DNA, 13 bp, C. elegans
tttttctgatgaa

SEQ ID NO: 746606 - DNA, 13 bp, C. elegans
tttttctgattca

SEQ ID NO: 746607 - DNA, 13 bp, C. elegans
tttttctgcaaga

SEQ ID NO: 746608 - DNA, 13 bp, C. elegans
tttttctgcaata

SEQ ID NO: 746609 - DNA, 13 bp, C. elegans
tttttctgcaatt

SEQ ID NO: 746610 - DNA, 13 bp, C. elegans
tttttctgcagaa

SEQ ID NO: 746611 - DNA, 13 bp, C. elegans
tttttctgccaat

SEQ ID NO: 746612 - DNA, 13 bp, C. elegans
tttttctgctcaa

SEQ ID NO: 746613 - DNA, 13 bp, C. elegans
tttttctgcttga

SEQ ID NO: 746614 - DNA, 13 bp, C. elegans
tttttctggaaga

SEQ ID NO: 746615 - DNA, 13 bp, C. elegans
tttttctggagaa

SEQ ID NO: 746616 - DNA, 13 bp, C. elegans
tttttctgggaaa

SEQ ID NO: 746617 - DNA, 14 bp, C. elegans
tttttctgtaaaat

SEQ ID NO: 746618 - DNA, 13 bp, C. elegans
tttttctgtaaac

SEQ ID NO: 746619 - DNA, 13 bp, C. elegans
tttttctgtaagt

SEQ ID NO: 746620 - DNA, 13 bp, C. elegans
tttttctgtacga

SEQ ID NO: 746621 - DNA, 13 bp, C. elegans
tttttctgtagaa

SEQ ID NO: 746622 - DNA, 13 bp, C. elegans
tttttctgtctga

SEQ ID NO: 746623 - DNA, 13 bp, C. elegans
tttttctgtgaaa

SEQ ID NO: 746624 - DNA, 13 bp, C. elegans
tttttctgtgcaa

SEQ ID NO: 746625 - DNA, 13 bp, C. elegans
tttttctgttaaa

SEQ ID NO: 746626 - DNA, 13 bp, C. elegans
tttttcttaagaa

SEQ ID NO: 746627 - DNA, 13 bp, C. elegans
tttttcttactga

SEQ ID NO: 746628 - DNA, 13 bp, C. elegans
tttttcttcaatg

SEQ ID NO: 746629 - DNA, 13 bp, C. elegans
tttttcttcacaa

SEQ ID NO: 746630 - DNA, 13 bp, C. elegans
tttttcttcagaa

SEQ ID NO: 746631 - DNA, 13 bp, C. elegans
tttttcttcccaa

SEQ ID NO: 746632 - DNA, 13 bp, C. elegans
tttttcttcgata

SEQ ID NO: 746633 - DNA, 13 bp, C. elegans
tttttcttctgaa

SEQ ID NO: 746634 - DNA, 13 bp, C. elegans
tttttcttgaaaa

SEQ ID NO: 746635 - DNA, 13 bp, C. elegans
tttttcttgaaac

SEQ ID NO: 746636 - DNA, 13 bp, C. elegans
tttttcttgaaat

SEQ ID NO: 746637 - DNA, 14 bp, C. elegans
tttttcttgaaata

SEQ ID NO: 746638 - DNA, 13 bp, C. elegans
tttttcttgaata

SEQ ID NO: 746639 - DNA, 13 bp, C. elegans
tttttcttgagaa

SEQ ID NO: 746640 - DNA, 13 bp, C. elegans
tttttcttgcaaa

SEQ ID NO: 746641 - DNA, 13 bp, C. elegans
tttttcttgtaac

SEQ ID NO: 746642 - DNA, 13 bp, C. elegans
tttttcttgtcca

SEQ ID NO: 746643 - DNA, 13 bp, C. elegans
tttttctttagaa

SEQ ID NO: 746644 - DNA, 13 bp, C. elegans
tttttctttcaag

SEQ ID NO: 746645 - DNA, 13 bp, C. elegans
tttttctttgcaa

SEQ ID NO: 746646 - DNA, 13 bp, C. elegans
tttttctttggaa

SEQ ID NO: 746647 - DNA, 13 bp, C. elegans
tttttgaaaaaac

SEQ ID NO: 746648 - DNA, 13 bp, C. elegans
tttttgaaaaacg

SEQ ID NO: 746649 - DNA, 13 bp, C. elegans
tttttgaaaaagc

SEQ ID NO: 746650 - DNA, 13 bp, C. elegans
tttttgaaaaatc

SEQ ID NO: 746651 - DNA, 13 bp, C. elegans
tttttgaaaaatg

SEQ ID NO: 746652 - DNA, 13 bp, C. elegans
tttttgaaaacca

SEQ ID NO: 746653 - DNA, 13 bp, C. elegans
tttttgaaaacta

SEQ ID NO: 746654 - DNA, 13 bp, C. elegans
tttttgaaaactt

SEQ ID NO: 746655 - DNA, 13 bp, C. elegans
tttttgaaaagaa

SEQ ID NO: 746656 - DNA, 13 bp, C. elegans
tttttgaaaagct

SEQ ID NO: 746657 - DNA, 13 bp, C. elegans
tttttgaaaatac

SEQ ID NO: 746658 - DNA, 13 bp, C. elegans
tttttgaaaatga

SEQ ID NO: 746659 - DNA, 13 bp, C. elegans
tttttgaaaattc

SEQ ID NO: 746660 - DNA, 14 bp, C. elegans
tttttgaaacaata

SEQ ID NO: 746661 - DNA, 13 bp, C. elegans
tttttgaaacacc

SEQ ID NO: 746662 - DNA, 13 bp, C. elegans
tttttgaaacagg

SEQ ID NO: 746663 - DNA, 13 bp, C. elegans
tttttgaaacagt

SEQ ID NO: 746664 - DNA, 13 bp, C. elegans
tttttgaaacatt

SEQ ID NO: 746665 - DNA, 13 bp, C. elegans
tttttgaaacgaa

SEQ ID NO: 746666 - DNA, 13 bp, C. elegans
tttttgaaacttt

SEQ ID NO: 746667 - DNA, 13 bp, C. elegans
tttttgaaagaat

SEQ ID NO: 746668 - DNA, 13 bp, C. elegans
tttttgaaagatg

SEQ ID NO: 746669 - DNA, 13 bp, C. elegans
tttttgaaagatt

SEQ ID NO: 746670 - DNA, 13 bp, C. elegans
tttttgaaagtca

SEQ ID NO: 746671 - DNA, 13 bp, C. elegans
tttttgaaagtgg

SEQ ID NO: 746672 - DNA, 13 bp, C. elegans
tttttgaaataga

SEQ ID NO: 746673 - DNA, 13 bp, C. elegans
tttttgaaatcaa

SEQ ID NO: 746674 - DNA, 13 bp, C. elegans
tttttgaaatctt

SEQ ID NO: 746675 - DNA, 13 bp, C. elegans
tttttgaaatgat

SEQ ID NO: 746676 - DNA, 13 bp, C. elegans
tttttgaaatgtc

SEQ ID NO: 746677 - DNA, 13 bp, C. elegans
tttttgaaatgtg

SEQ ID NO: 746678 - DNA, 13 bp, C. elegans
tttttgaaattcc

SEQ ID NO: 746679 - DNA, 13 bp, C. elegans
tttttgaaattga

SEQ ID NO: 746680 - DNA, 13 bp, C. elegans
tttttgaaatttc

SEQ ID NO: 746681 - DNA, 14 bp, C. elegans
tttttgaaatttct

SEQ ID NO: 746682 - DNA, 13 bp, C. elegans
tttttgaacaata

SEQ ID NO: 746683 - DNA, 13 bp, C. elegans
tttttgaacaatt

SEQ ID NO: 746684 - DNA, 13 bp, C. elegans
tttttgaacactt

SEQ ID NO: 746685 - DNA, 13 bp, C. elegans
tttttgaacagta

SEQ ID NO: 746686 - DNA, 13 bp, C. elegans
tttttgaacatat

SEQ ID NO: 746687 - DNA, 13 bp, C. elegans
tttttgaacatca

SEQ ID NO: 746688 - DNA, 13 bp, C. elegans
tttttgaacattc

SEQ ID NO: 746689 - DNA, 13 bp, C. elegans
tttttgaaccatt

SEQ ID NO: 746690 - DNA, 13 bp, C. elegans
tttttgaaccgcc

SEQ ID NO: 746691 - DNA, 13 bp, C. elegans
tttttgaacgttt

SEQ ID NO: 746692 - DNA, 13 bp, C. elegans
tttttgaactgta

SEQ ID NO: 746693 - DNA, 13 bp, C. elegans
tttttgaacttgt

SEQ ID NO: 746694 - DNA, 13 bp, C. elegans
tttttgaagaaaa

SEQ ID NO: 746695 - DNA, 13 bp, C. elegans
tttttgaagaaat

SEQ ID NO: 746696 - DNA, 13 bp, C. elegans
tttttgaagaact

SEQ ID NO: 746697 - DNA, 14 bp, C. elegans
tttttgaagaattt

SEQ ID NO: 746698 - DNA, 13 bp, C. elegans
tttttgaagacaa

SEQ ID NO: 746699 - DNA, 13 bp, C. elegans
tttttgaagagaa

SEQ ID NO: 746700 - DNA, 13 bp, C. elegans
tttttgaagcaca

SEQ ID NO: 746701 - DNA, 13 bp, C. elegans
tttttgaagcttc

SEQ ID NO: 746702 - DNA, 13 bp, C. elegans
tttttgaaggaaa

SEQ ID NO: 746703 - DNA, 13 bp, C. elegans
tttttgaagtctt

SEQ ID NO: 746704 - DNA, 13 bp, C. elegans
tttttgaagttac

SEQ ID NO: 746705 - DNA, 13 bp, C. elegans
tttttgaagttct

SEQ ID NO: 746706 - DNA, 13 bp, C. elegans
tttttgaagtttc

SEQ ID NO: 746707 - DNA, 13 bp, C. elegans
tttttgaataaag

SEQ ID NO: 746708 - DNA, 13 bp, C. elegans
tttttgaataacc

SEQ ID NO: 746709 - DNA, 13 bp, C. elegans
tttttgaataatg

SEQ ID NO: 746710 - DNA, 13 bp, C. elegans
tttttgaatagaa

SEQ ID NO: 746711 - DNA, 13 bp, C. elegans
tttttgaatatcg

SEQ ID NO: 746712 - DNA, 13 bp, C. elegans
tttttgaatattc

SEQ ID NO: 746713 - DNA, 14 bp, C. elegans
tttttgaatattcc

SEQ ID NO: 746714 - DNA, 13 bp, C. elegans
tttttgaatccaa

SEQ ID NO: 746715 - DNA, 13 bp, C. elegans
tttttgaatcttg

SEQ ID NO: 746716 - DNA, 13 bp, C. elegans
tttttgaatgaaa

SEQ ID NO: 746717 - DNA, 13 bp, C. elegans
tttttgaatgata

SEQ ID NO: 746718 - DNA, 13 bp, C. elegans
tttttgaatgatc

SEQ ID NO: 746719 - DNA, 13 bp, C. elegans
tttttgaatggaa

SEQ ID NO: 746720 - DNA, 13 bp, C. elegans
tttttgaatgttc

SEQ ID NO: 746721 - DNA, 13 bp, C. elegans
tttttgaattatc

SEQ ID NO: 746722 - DNA, 13 bp, C. elegans
tttttgaattgaa

SEQ ID NO: 746723 - DNA, 13 bp, C. elegans
tttttgaatttcc

SEQ ID NO: 746724 - DNA, 13 bp, C. elegans
tttttgacaattg

SEQ ID NO: 746725 - DNA, 13 bp, C. elegans
tttttgacacaaa

SEQ ID NO: 746726 - DNA, 13 bp, C. elegans
tttttgacagaat

SEQ ID NO: 746727 - DNA, 13 bp, C. elegans
tttttgacagctt

SEQ ID NO: 746728 - DNA, 13 bp, C. elegans
tttttgacagtaa

SEQ ID NO: 746729 - DNA, 13 bp, C. elegans
tttttgacatctt

SEQ ID NO: 746730 - DNA, 13 bp, C. elegans
tttttgacattca

SEQ ID NO: 746731 - DNA, 13 bp, C. elegans
tttttgacattta

SEQ ID NO: 746732 - DNA, 13 bp, C. elegans
tttttgaccaccc

SEQ ID NO: 746733 - DNA, 13 bp, C. elegans
tttttgaccattt

SEQ ID NO: 746734 - DNA, 13 bp, C. elegans
tttttgacccatt

SEQ ID NO: 746735 - DNA, 13 bp, C. elegans
tttttgacgaaaa

SEQ ID NO: 746736 - DNA, 13 bp, C. elegans
tttttgacgaatt

SEQ ID NO: 746737 - DNA, 13 bp, C. elegans
tttttgacgactt

SEQ ID NO: 746738 - DNA, 13 bp, C. elegans
tttttgacgatga

SEQ ID NO: 746739 - DNA, 13 bp, C. elegans
tttttgactaaaa

SEQ ID NO: 746740 - DNA, 13 bp, C. elegans
tttttgactatta

SEQ ID NO: 746741 - DNA, 13 bp, C. elegans
tttttgactcaaa

SEQ ID NO: 746742 - DNA, 13 bp, C. elegans
tttttgactcatt

SEQ ID NO: 746743 - DNA, 13 bp, C. elegans
tttttgactgatt

SEQ ID NO: 746744 - DNA, 13 bp, C. elegans
tttttgacttcaa

SEQ ID NO: 746745 - DNA, 13 bp, C. elegans
tttttgactttaa

SEQ ID NO: 746746 - DNA, 13 bp, C. elegans
tttttgagaaaac

SEQ ID NO: 746747 - DNA, 13 bp, C. elegans
tttttgagaaata

SEQ ID NO: 746748 - DNA, 13 bp, C. elegans
tttttgagaaatt

SEQ ID NO: 746749 - DNA, 13 bp, C. elegans
tttttgagacaat

SEQ ID NO: 746750 - DNA, 13 bp, C. elegans
tttttgagataaa

SEQ ID NO: 746751 - DNA, 13 bp, C. elegans
tttttgagataat

SEQ ID NO: 746752 - DNA, 13 bp, C. elegans
tttttgagcaaaa

SEQ ID NO: 746753 - DNA, 13 bp, C. elegans
tttttgagcaaac

SEQ ID NO: 746754 - DNA, 13 bp, C. elegans
tttttgagcagct

SEQ ID NO: 746755 - DNA, 13 bp, C. elegans
tttttgagcattc

SEQ ID NO: 746756 - DNA, 13 bp, C. elegans
tttttgagcattt

SEQ ID NO: 746757 - DNA, 13 bp, C. elegans
tttttgagccgtc

SEQ ID NO: 746758 - DNA, 13 bp, C. elegans
tttttgagctcca

SEQ ID NO: 746759 - DNA, 13 bp, C. elegans
tttttgagctgtt

SEQ ID NO: 746760 - DNA, 13 bp, C. elegans
tttttgaggaaaa

SEQ ID NO: 746761 - DNA, 13 bp, C. elegans
tttttgaggaaca

SEQ ID NO: 746762 - DNA, 13 bp, C. elegans
tttttgagggatt

SEQ ID NO: 746763 - DNA, 13 bp, C. elegans
tttttgagtaaaa

SEQ ID NO: 746764 - DNA, 13 bp, C. elegans
tttttgagtaata

SEQ ID NO: 746765 - DNA, 13 bp, C. elegans
tttttgagtggaa

SEQ ID NO: 746766 - DNA, 13 bp, C. elegans
tttttgagtttca

SEQ ID NO: 746767 - DNA, 13 bp, C. elegans
tttttgataaaac

SEQ ID NO: 746768 - DNA, 13 bp, C. elegans
tttttgataaact

SEQ ID NO: 746769 - DNA, 13 bp, C. elegans
tttttgataaatc

SEQ ID NO: 746770 - DNA, 13 bp, C. elegans
tttttgataactt

SEQ ID NO: 746771 - DNA, 13 bp, C. elegans
tttttgatacaaa

SEQ ID NO: 746772 - DNA, 13 bp, C. elegans
tttttgatagatc

SEQ ID NO: 746773 - DNA, 13 bp, C. elegans
tttttgatcaaat

SEQ ID NO: 746774 - DNA, 13 bp, C. elegans
tttttgatcagtt

SEQ ID NO: 746775 - DNA, 13 bp, C. elegans
tttttgatgaaaa

SEQ ID NO: 746776 - DNA, 13 bp, C. elegans
tttttgatgacta

SEQ ID NO: 746777 - DNA, 13 bp, C. elegans
tttttgatgactt

SEQ ID NO: 746778 - DNA, 13 bp, C. elegans
tttttgatgttcc

SEQ ID NO: 746779 - DNA, 13 bp, C. elegans
tttttgattcaaa

SEQ ID NO: 746780 - DNA, 13 bp, C. elegans
tttttgattcata

SEQ ID NO: 746781 - DNA, 13 bp, C. elegans
tttttgattccat

SEQ ID NO: 746782 - DNA, 14 bp, C. elegans
tttttgcaaaaaaa

SEQ ID NO: 746783 - DNA, 13 bp, C. elegans
tttttgcaaaaat

SEQ ID NO: 746784 - DNA, 13 bp, C. elegans
tttttgcaaaatc

SEQ ID NO: 746785 - DNA, 13 bp, C. elegans
tttttgcaaaatg

SEQ ID NO: 746786 - DNA, 13 bp, C. elegans
tttttgcaaaatt

SEQ ID NO: 746787 - DNA, 13 bp, C. elegans
tttttgcaaactt

SEQ ID NO: 746788 - DNA, 13 bp, C. elegans
tttttgcaaagtt

SEQ ID NO: 746789 - DNA, 13 bp, C. elegans
tttttgcaaattt

SEQ ID NO: 746790 - DNA, 13 bp, C. elegans
tttttgcaacaaa

SEQ ID NO: 746791 - DNA, 13 bp, C. elegans
tttttgcaagaat

SEQ ID NO: 746792 - DNA, 13 bp, C. elegans
tttttgcaatatt

SEQ ID NO: 746793 - DNA, 13 bp, C. elegans
tttttgcaatgtt

SEQ ID NO: 746794 - DNA, 13 bp, C. elegans
tttttgcaattta

SEQ ID NO: 746795 - DNA, 13 bp, C. elegans
tttttgcaatttc

SEQ ID NO: 746796 - DNA, 13 bp, C. elegans
tttttgcaatttg

SEQ ID NO: 746797 - DNA, 13 bp, C. elegans
tttttgcacaaaa

SEQ ID NO: 746798 - DNA, 13 bp, C. elegans
tttttgcacaata

SEQ ID NO: 746799 - DNA, 13 bp, C. elegans
tttttgcacaatt

SEQ ID NO: 746800 - DNA, 13 bp, C. elegans
tttttgcacattt

SEQ ID NO: 746801 - DNA, 13 bp, C. elegans
tttttgcagaaaa

SEQ ID NO: 746802 - DNA, 13 bp, C. elegans
tttttgcagaatc

SEQ ID NO: 746803 - DNA, 13 bp, C. elegans
tttttgcagatga

SEQ ID NO: 746804 - DNA, 14 bp, C. elegans
tttttgcagatgct

SEQ ID NO: 746805 - DNA, 13 bp, C. elegans
tttttgcagattt

SEQ ID NO: 746806 - DNA, 13 bp, C. elegans
tttttgcagttct

SEQ ID NO: 746807 - DNA, 13 bp, C. elegans
tttttgcagtttc

SEQ ID NO: 746808 - DNA, 13 bp, C. elegans
tttttgcataaac

SEQ ID NO: 746809 - DNA, 13 bp, C. elegans
tttttgcatataa

SEQ ID NO: 746810 - DNA, 13 bp, C. elegans
tttttgcatcaaa

SEQ ID NO: 746811 - DNA, 13 bp, C. elegans
tttttgcatgttc

SEQ ID NO: 746812 - DNA, 13 bp, C. elegans
tttttgcattcaa

SEQ ID NO: 746813 - DNA, 13 bp, C. elegans
tttttgcatttaa

SEQ ID NO: 746814 - DNA, 13 bp, C. elegans
tttttgccaaaaa

SEQ ID NO: 746815 - DNA, 13 bp, C. elegans
tttttgccaaaac

SEQ ID NO: 746816 - DNA, 13 bp, C. elegans
tttttgccaaata

SEQ ID NO: 746817 - DNA, 13 bp, C. elegans
tttttgccaattc

SEQ ID NO: 746818 - DNA, 13 bp, C. elegans
tttttgccaattt

SEQ ID NO: 746819 - DNA, 13 bp, C. elegans
tttttgccacatt

SEQ ID NO: 746820 - DNA, 13 bp, C. elegans
tttttgccagaaa

SEQ ID NO: 746821 - DNA, 13 bp, C. elegans
tttttgccagatt

SEQ ID NO: 746822 - DNA, 13 bp, C. elegans
tttttgccatctc

SEQ ID NO: 746823 - DNA, 13 bp, C. elegans
tttttgcccaaaa

SEQ ID NO: 746824 - DNA, 13 bp, C. elegans
tttttgcccattt

SEQ ID NO: 746825 - DNA, 13 bp, C. elegans
tttttgccgggaa

SEQ ID NO: 746826 - DNA, 13 bp, C. elegans
tttttgcctaaaa

SEQ ID NO: 746827 - DNA, 13 bp, C. elegans
tttttgcctcaaa

SEQ ID NO: 746828 - DNA, 13 bp, C. elegans
tttttgcctgaaa

SEQ ID NO: 746829 - DNA, 13 bp, C. elegans
tttttgcctgaat

SEQ ID NO: 746830 - DNA, 13 bp, C. elegans
tttttgcctgatt

SEQ ID NO: 746831 - DNA, 13 bp, C. elegans
tttttgcgaaaaa

SEQ ID NO: 746832 - DNA, 13 bp, C. elegans
tttttgcgaaatt

SEQ ID NO: 746833 - DNA, 13 bp, C. elegans
tttttgcgaattt

SEQ ID NO: 746834 - DNA, 13 bp, C. elegans
tttttgcgacaaa

SEQ ID NO: 746835 - DNA, 13 bp, C. elegans
tttttgcgataaa

SEQ ID NO: 746836 - DNA, 13 bp, C. elegans
tttttgcgctaaa

SEQ ID NO: 746837 - DNA, 13 bp, C. elegans
tttttgcggaaaa

SEQ ID NO: 746838 - DNA, 13 bp, C. elegans
tttttgctaaaaa

SEQ ID NO: 746839 - DNA, 13 bp, C. elegans
tttttgctaaatt

SEQ ID NO: 746840 - DNA, 13 bp, C. elegans
tttttgctaattc

SEQ ID NO: 746841 - DNA, 13 bp, C. elegans
tttttgctcaaaa

SEQ ID NO: 746842 - DNA, 13 bp, C. elegans
tttttgctcaaat

SEQ ID NO: 746843 - DNA, 13 bp, C. elegans
tttttgctcaata

SEQ ID NO: 746844 - DNA, 13 bp, C. elegans
tttttgctccacc

SEQ ID NO: 746845 - DNA, 13 bp, C. elegans
tttttgctgaaaa

SEQ ID NO: 746846 - DNA, 13 bp, C. elegans
tttttgctgaaat

SEQ ID NO: 746847 - DNA, 13 bp, C. elegans
tttttgctgaaca

SEQ ID NO: 746848 - DNA, 13 bp, C. elegans
tttttgctgttaa

SEQ ID NO: 746849 - DNA, 13 bp, C. elegans
tttttgcttgaaa

SEQ ID NO: 746850 - DNA, 13 bp, C. elegans
tttttgctttcca

SEQ ID NO: 746851 - DNA, 13 bp, C. elegans
tttttggaaaaac

SEQ ID NO: 746852 - DNA, 13 bp, C. elegans
tttttggaaaaat

SEQ ID NO: 746853 - DNA, 13 bp, C. elegans
tttttggaaaacc

SEQ ID NO: 746854 - DNA, 13 bp, C. elegans
tttttggaaaact

SEQ ID NO: 746855 - DNA, 13 bp, C. elegans
tttttggaaaagt

SEQ ID NO: 746856 - DNA, 13 bp, C. elegans
tttttggaaaatc

SEQ ID NO: 746857 - DNA, 13 bp, C. elegans
tttttggaaaatg

SEQ ID NO: 746858 - DNA, 13 bp, C. elegans
tttttggaaacaa

SEQ ID NO: 746859 - DNA, 13 bp, C. elegans
tttttggaaacca

SEQ ID NO: 746860 - DNA, 13 bp, C. elegans
tttttggaaactt

SEQ ID NO: 746861 - DNA, 13 bp, C. elegans
tttttggaaagaa

SEQ ID NO: 746862 - DNA, 13 bp, C. elegans
tttttggaaataa

SEQ ID NO: 746863 - DNA, 13 bp, C. elegans
tttttggaacacc

SEQ ID NO: 746864 - DNA, 13 bp, C. elegans
tttttggaagaaa

SEQ ID NO: 746865 - DNA, 13 bp, C. elegans
tttttggaataaa

SEQ ID NO: 746866 - DNA, 13 bp, C. elegans
tttttggaataat

SEQ ID NO: 746867 - DNA, 13 bp, C. elegans
tttttggaatgct

SEQ ID NO: 746868 - DNA, 13 bp, C. elegans
tttttggacggaa

SEQ ID NO: 746869 - DNA, 13 bp, C. elegans
tttttggagaaaa

SEQ ID NO: 746870 - DNA, 13 bp, C. elegans
tttttggagaaac

SEQ ID NO: 746871 - DNA, 13 bp, C. elegans
tttttggagaatc

SEQ ID NO: 746872 - DNA, 13 bp, C. elegans
tttttggagcaaa

SEQ ID NO: 746873 - DNA, 13 bp, C. elegans
tttttggagcttt

SEQ ID NO: 746874 - DNA, 13 bp, C. elegans
tttttggaggaaa

SEQ ID NO: 746875 - DNA, 13 bp, C. elegans
tttttggagtgat

SEQ ID NO: 746876 - DNA, 13 bp, C. elegans
tttttggataaaa

SEQ ID NO: 746877 - DNA, 13 bp, C. elegans
tttttggataaat

SEQ ID NO: 746878 - DNA, 13 bp, C. elegans
tttttggatacaa

SEQ ID NO: 746879 - DNA, 13 bp, C. elegans
tttttggatataa

SEQ ID NO: 746880 - DNA, 13 bp, C. elegans
tttttggatgaga

SEQ ID NO: 746881 - DNA, 13 bp, C. elegans
tttttggcaaaaa

SEQ ID NO: 746882 - DNA, 13 bp, C. elegans
tttttggcaaatt

SEQ ID NO: 746883 - DNA, 13 bp, C. elegans
tttttggcaattt

SEQ ID NO: 746884 - DNA, 13 bp, C. elegans
tttttggcagaaa

SEQ ID NO: 746885 - DNA, 13 bp, C. elegans
tttttggcatttg

SEQ ID NO: 746886 - DNA, 13 bp, C. elegans
tttttggcccaaa

SEQ ID NO: 746887 - DNA, 13 bp, C. elegans
tttttggcctgaa

SEQ ID NO: 746888 - DNA, 13 bp, C. elegans
tttttggcgaaaa

SEQ ID NO: 746889 - DNA, 13 bp, C. elegans
tttttggctaaaa

SEQ ID NO: 746890 - DNA, 13 bp, C. elegans
tttttggctatat

SEQ ID NO: 746891 - DNA, 13 bp, C. elegans
tttttggctcaaa

SEQ ID NO: 746892 - DNA, 13 bp, C. elegans
tttttggctgaat

SEQ ID NO: 746893 - DNA, 13 bp, C. elegans
tttttggcttcaa

SEQ ID NO: 746894 - DNA, 13 bp, C. elegans
tttttggcttcac

SEQ ID NO: 746895 - DNA, 13 bp, C. elegans
tttttgggaaaca

SEQ ID NO: 746896 - DNA, 13 bp, C. elegans
tttttgggaaagt

SEQ ID NO: 746897 - DNA, 13 bp, C. elegans
tttttgggaacaa

SEQ ID NO: 746898 - DNA, 13 bp, C. elegans
tttttgggaatat

SEQ ID NO: 746899 - DNA, 13 bp, C. elegans
tttttgggacatt

SEQ ID NO: 746900 - DNA, 13 bp, C. elegans
tttttgggatttc

SEQ ID NO: 746901 - DNA, 13 bp, C. elegans
tttttgggcgaaa

SEQ ID NO: 746902 - DNA, 13 bp, C. elegans
tttttggggaaaa

SEQ ID NO: 746903 - DNA, 13 bp, C. elegans
tttttgggtaaaa

SEQ ID NO: 746904 - DNA, 13 bp, C. elegans
tttttgggtactt

SEQ ID NO: 746905 - DNA, 13 bp, C. elegans
tttttggtaaaaa

SEQ ID NO: 746906 - DNA, 13 bp, C. elegans
tttttggtaaaca

SEQ ID NO: 746907 - DNA, 13 bp, C. elegans
tttttggtaattc

SEQ ID NO: 746908 - DNA, 13 bp, C. elegans
tttttggtacaaa

SEQ ID NO: 746909 - DNA, 13 bp, C. elegans
tttttggtagaaa

SEQ ID NO: 746910 - DNA, 13 bp, C. elegans
tttttggtatgaa

SEQ ID NO: 746911 - DNA, 13 bp, C. elegans
tttttggtattca

SEQ ID NO: 746912 - DNA, 13 bp, C. elegans
tttttggtcgaaa

SEQ ID NO: 746913 - DNA, 13 bp, C. elegans
tttttggtctgaa

SEQ ID NO: 746914 - DNA, 13 bp, C. elegans
tttttggtgaaaa

SEQ ID NO: 746915 - DNA, 13 bp, C. elegans
tttttggtgaact

SEQ ID NO: 746916 - DNA, 13 bp, C. elegans
tttttggtgatga

SEQ ID NO: 746917 - DNA, 13 bp, C. elegans
tttttggtgattc

SEQ ID NO: 746918 - DNA, 13 bp, C. elegans
tttttggtggaaa

SEQ ID NO: 746919 - DNA, 13 bp, C. elegans
tttttggtgtaaa

SEQ ID NO: 746920 - DNA, 13 bp, C. elegans
tttttggttaaaa

SEQ ID NO: 746921 - DNA, 13 bp, C. elegans
tttttggttcaaa

SEQ ID NO: 746922 - DNA, 13 bp, C. elegans
tttttggtttcca

SEQ ID NO: 746923 - DNA, 13 bp, C. elegans
tttttgtaaaaac

SEQ ID NO: 746924 - DNA, 13 bp, C. elegans
tttttgtaaaatc

SEQ ID NO: 746925 - DNA, 13 bp, C. elegans
tttttgtaaatac

SEQ ID NO: 746926 - DNA, 13 bp, C. elegans
tttttgtaacaaa

SEQ ID NO: 746927 - DNA, 13 bp, C. elegans
tttttgtaacata

SEQ ID NO: 746928 - DNA, 13 bp, C. elegans
tttttgtaacatt

SEQ ID NO: 746929 - DNA, 13 bp, C. elegans
tttttgtacaaaa

SEQ ID NO: 746930 - DNA, 13 bp, C. elegans
tttttgtacaatt

SEQ ID NO: 746931 - DNA, 13 bp, C. elegans
tttttgtacagaa

SEQ ID NO: 746932 - DNA, 13 bp, C. elegans
tttttgtacagtt

SEQ ID NO: 746933 - DNA, 13 bp, C. elegans
tttttgtacataa

SEQ ID NO: 746934 - DNA, 13 bp, C. elegans
tttttgtacgaaa

SEQ ID NO: 746935 - DNA, 13 bp, C. elegans
tttttgtagaaaa

SEQ ID NO: 746936 - DNA, 13 bp, C. elegans
tttttgtagaagt

SEQ ID NO: 746937 - DNA, 13 bp, C. elegans
tttttgtagactt

SEQ ID NO: 746938 - DNA, 13 bp, C. elegans
tttttgtagatca

SEQ ID NO: 746939 - DNA, 13 bp, C. elegans
tttttgtagatga

SEQ ID NO: 746940 - DNA, 13 bp, C. elegans
tttttgtagcatt

SEQ ID NO: 746941 - DNA, 13 bp, C. elegans
tttttgtaggaaa

SEQ ID NO: 746942 - DNA, 13 bp, C. elegans
tttttgtataaac

SEQ ID NO: 746943 - DNA, 13 bp, C. elegans
tttttgtatagaa

SEQ ID NO: 746944 - DNA, 13 bp, C. elegans
tttttgtcaaagt

SEQ ID NO: 746945 - DNA, 13 bp, C. elegans
tttttgtcacaaa

SEQ ID NO: 746946 - DNA, 13 bp, C. elegans
tttttgtcagaat

SEQ ID NO: 746947 - DNA, 13 bp, C. elegans
tttttgtcataaa

SEQ ID NO: 746948 - DNA, 13 bp, C. elegans
tttttgtcatcaa

SEQ ID NO: 746949 - DNA, 13 bp, C. elegans
tttttgtcatcat

SEQ ID NO: 746950 - DNA, 13 bp, C. elegans
tttttgtcattca

SEQ ID NO: 746951 - DNA, 13 bp, C. elegans
tttttgtccaaaa

SEQ ID NO: 746952 - DNA, 13 bp, C. elegans
tttttgtcgaaaa

SEQ ID NO: 746953 - DNA, 13 bp, C. elegans
tttttgtcgcaaa

SEQ ID NO: 746954 - DNA, 13 bp, C. elegans
tttttgtcggaat

SEQ ID NO: 746955 - DNA, 13 bp, C. elegans
tttttgtctaaaa

SEQ ID NO: 746956 - DNA, 13 bp, C. elegans
tttttgtctagaa

SEQ ID NO: 746957 - DNA, 13 bp, C. elegans
tttttgtctcaaa

SEQ ID NO: 746958 - DNA, 13 bp, C. elegans
tttttgtctcgaa

SEQ ID NO: 746959 - DNA, 13 bp, C. elegans
tttttgtctgaaa

SEQ ID NO: 746960 - DNA, 13 bp, C. elegans
tttttgtgaaacg

SEQ ID NO: 746961 - DNA, 13 bp, C. elegans
tttttgtgaaaga

SEQ ID NO: 746962 - DNA, 13 bp, C. elegans
tttttgtgaactt

SEQ ID NO: 746963 - DNA, 13 bp, C. elegans
tttttgtgagaaa

SEQ ID NO: 746964 - DNA, 13 bp, C. elegans
tttttgtgataaa

SEQ ID NO: 746965 - DNA, 13 bp, C. elegans
tttttgtgcagtt

SEQ ID NO: 746966 - DNA, 13 bp, C. elegans
tttttgtgcatta

SEQ ID NO: 746967 - DNA, 13 bp, C. elegans
tttttgtgcctac

SEQ ID NO: 746968 - DNA, 13 bp, C. elegans
tttttgtgctaat

SEQ ID NO: 746969 - DNA, 13 bp, C. elegans
tttttgtggaaaa

SEQ ID NO: 746970 - DNA, 13 bp, C. elegans
tttttgtggaaat

SEQ ID NO: 746971 - DNA, 13 bp, C. elegans
tttttgtggagaa

SEQ ID NO: 746972 - DNA, 13 bp, C. elegans
tttttgtggataa

SEQ ID NO: 746973 - DNA, 13 bp, C. elegans
tttttgtggcaaa

SEQ ID NO: 746974 - DNA, 13 bp, C. elegans
tttttgtgggaaa

SEQ ID NO: 746975 - DNA, 13 bp, C. elegans
tttttgtgtgaaa

SEQ ID NO: 746976 - DNA, 13 bp, C. elegans
tttttgttaaaac

SEQ ID NO: 746977 - DNA, 13 bp, C. elegans
tttttgttacaaa

SEQ ID NO: 746978 - DNA, 13 bp, C. elegans
tttttgttagaaa

SEQ ID NO: 746979 - DNA, 13 bp, C. elegans
tttttgttatcaa

SEQ ID NO: 746980 - DNA, 13 bp, C. elegans
tttttgttcaaaa

SEQ ID NO: 746981 - DNA, 13 bp, C. elegans
tttttgttccaat

SEQ ID NO: 746982 - DNA, 13 bp, C. elegans
tttttgttccagt

SEQ ID NO: 746983 - DNA, 13 bp, C. elegans
tttttgttccgca

SEQ ID NO: 746984 - DNA, 13 bp, C. elegans
tttttgttcctca

SEQ ID NO: 746985 - DNA, 13 bp, C. elegans
tttttgttcggaa

SEQ ID NO: 746986 - DNA, 13 bp, C. elegans
tttttgttctaaa

SEQ ID NO: 746987 - DNA, 13 bp, C. elegans
tttttgttgaaaa

SEQ ID NO: 746988 - DNA, 13 bp, C. elegans
tttttgttgagaa

SEQ ID NO: 746989 - DNA, 13 bp, C. elegans
tttttgttgcaat

SEQ ID NO: 746990 - DNA, 13 bp, C. elegans
tttttgttgcaca

SEQ ID NO: 746991 - DNA, 13 bp, C. elegans
tttttgttggaaa

SEQ ID NO: 746992 - DNA, 13 bp, C. elegans
tttttgttggaga

SEQ ID NO: 746993 - DNA, 13 bp, C. elegans
tttttgtttacaa

SEQ ID NO: 746994 - DNA, 13 bp, C. elegans
tttttgtttccga

SEQ ID NO: 746995 - DNA, 13 bp, C. elegans
tttttgtttcgaa

SEQ ID NO: 746996 - DNA, 13 bp, C. elegans
ttttttaaaaacc

SEQ ID NO: 746997 - DNA, 14 bp, C. elegans
ttttttaaaaacga

SEQ ID NO: 746998 - DNA, 13 bp, C. elegans
ttttttaaaacca

SEQ ID NO: 746999 - DNA, 13 bp, C. elegans
ttttttaaaatgc

SEQ ID NO: 747000 - DNA, 13 bp, C. elegans
ttttttaaacaag

SEQ ID NO: 747001 - DNA, 13 bp, C. elegans
ttttttaaacgaa

SEQ ID NO: 747002 - DNA, 13 bp, C. elegans
ttttttaaactga

SEQ ID NO: 747003 - DNA, 13 bp, C. elegans
ttttttaaagcat

SEQ ID NO: 747004 - DNA, 13 bp, C. elegans
ttttttaaccaaa

SEQ ID NO: 747005 - DNA, 13 bp, C. elegans
ttttttaaccata

SEQ ID NO: 747006 - DNA, 13 bp, C. elegans
ttttttaacgaaa

SEQ ID NO: 747007 - DNA, 13 bp, C. elegans
ttttttaactcaa

SEQ ID NO: 747008 - DNA, 13 bp, C. elegans
ttttttaagcaaa

SEQ ID NO: 747009 - DNA, 13 bp, C. elegans
ttttttaaggcaa

SEQ ID NO: 747010 - DNA, 13 bp, C. elegans
ttttttaagtaca

SEQ ID NO: 747011 - DNA, 13 bp, C. elegans
ttttttaatccaa

SEQ ID NO: 747012 - DNA, 13 bp, C. elegans
ttttttaatgcta

SEQ ID NO: 747013 - DNA, 13 bp, C. elegans
ttttttaatggaa

SEQ ID NO: 747014 - DNA, 13 bp, C. elegans
ttttttacaaaac

SEQ ID NO: 747015 - DNA, 13 bp, C. elegans
ttttttacaaagt

SEQ ID NO: 747016 - DNA, 13 bp, C. elegans
ttttttacacaaa

SEQ ID NO: 747017 - DNA, 13 bp, C. elegans
ttttttacacaat

SEQ ID NO: 747018 - DNA, 13 bp, C. elegans
ttttttacagaaa

SEQ ID NO: 747019 - DNA, 13 bp, C. elegans
ttttttacagtca

SEQ ID NO: 747020 - DNA, 13 bp, C. elegans
ttttttacataca

SEQ ID NO: 747021 - DNA, 13 bp, C. elegans
ttttttaccgaat

SEQ ID NO: 747022 - DNA, 13 bp, C. elegans
ttttttaccgatt

SEQ ID NO: 747023 - DNA, 13 bp, C. elegans
ttttttacgaatt

SEQ ID NO: 747024 - DNA, 13 bp, C. elegans
ttttttactgaaa

SEQ ID NO: 747025 - DNA, 13 bp, C. elegans
ttttttactgaat

SEQ ID NO: 747026 - DNA, 13 bp, C. elegans
ttttttacttgaa

SEQ ID NO: 747027 - DNA, 13 bp, C. elegans
ttttttagaagat

SEQ ID NO: 747028 - DNA, 13 bp, C. elegans
ttttttagaatca

SEQ ID NO: 747029 - DNA, 13 bp, C. elegans
ttttttagacaaa

SEQ ID NO: 747030 - DNA, 13 bp, C. elegans
ttttttagatatc

SEQ ID NO: 747031 - DNA, 13 bp, C. elegans
ttttttagcaact

SEQ ID NO: 747032 - DNA, 13 bp, C. elegans
ttttttaggaaaa

SEQ ID NO: 747033 - DNA, 13 bp, C. elegans
ttttttagtcaaa

SEQ ID NO: 747034 - DNA, 13 bp, C. elegans
ttttttagttcaa

SEQ ID NO: 747035 - DNA, 13 bp, C. elegans
ttttttatcatga

SEQ ID NO: 747036 - DNA, 13 bp, C. elegans
ttttttatccgaa

SEQ ID NO: 747037 - DNA, 13 bp, C. elegans
ttttttatcgaaa

SEQ ID NO: 747038 - DNA, 13 bp, C. elegans
ttttttatcgata

SEQ ID NO: 747039 - DNA, 13 bp, C. elegans
ttttttatctgaa

SEQ ID NO: 747040 - DNA, 13 bp, C. elegans
ttttttatgcaaa

SEQ ID NO: 747041 - DNA, 13 bp, C. elegans
ttttttatggaaa

SEQ ID NO: 747042 - DNA, 13 bp, C. elegans
ttttttatgtcga

SEQ ID NO: 747043 - DNA, 13 bp, C. elegans
ttttttattacgg

SEQ ID NO: 747044 - DNA, 13 bp, C. elegans
ttttttattcccg

SEQ ID NO: 747045 - DNA, 13 bp, C. elegans
ttttttattcgaa

SEQ ID NO: 747046 - DNA, 13 bp, C. elegans
ttttttattgcaa

SEQ ID NO: 747047 - DNA, 13 bp, C. elegans
ttttttcaaaaac

SEQ ID NO: 747048 - DNA, 13 bp, C. elegans
ttttttcaaaaag

SEQ ID NO: 747049 - DNA, 13 bp, C. elegans
ttttttcaaaacg

SEQ ID NO: 747050 - DNA, 13 bp, C. elegans
ttttttcaaaatg

SEQ ID NO: 747051 - DNA, 14 bp, C. elegans
ttttttcaaactcc

SEQ ID NO: 747052 - DNA, 13 bp, C. elegans
ttttttcaaactg

SEQ ID NO: 747053 - DNA, 13 bp, C. elegans
ttttttcaaagta

SEQ ID NO: 747054 - DNA, 13 bp, C. elegans
ttttttcaaatcg

SEQ ID NO: 747055 - DNA, 13 bp, C. elegans
ttttttcaaatgt

SEQ ID NO: 747056 - DNA, 13 bp, C. elegans
ttttttcaaccat

SEQ ID NO: 747057 - DNA, 13 bp, C. elegans
ttttttcaactca

SEQ ID NO: 747058 - DNA, 13 bp, C. elegans
ttttttcaagaaa

SEQ ID NO: 747059 - DNA, 13 bp, C. elegans
ttttttcaagaca

SEQ ID NO: 747060 - DNA, 13 bp, C. elegans
ttttttcaagcca

SEQ ID NO: 747061 - DNA, 13 bp, C. elegans
ttttttcaagtat

SEQ ID NO: 747062 - DNA, 13 bp, C. elegans
ttttttcaagtgt

SEQ ID NO: 747063 - DNA, 13 bp, C. elegans
ttttttcaagtta

SEQ ID NO: 747064 - DNA, 13 bp, C. elegans
ttttttcaatgaa

SEQ ID NO: 747065 - DNA, 13 bp, C. elegans
ttttttcaatgta

SEQ ID NO: 747066 - DNA, 13 bp, C. elegans
ttttttcaatgtg

SEQ ID NO: 747067 - DNA, 13 bp, C. elegans
ttttttcacacca

SEQ ID NO: 747068 - DNA, 13 bp, C. elegans
ttttttcacagat

SEQ ID NO: 747069 - DNA, 13 bp, C. elegans
ttttttcacgatt

SEQ ID NO: 747070 - DNA, 13 bp, C. elegans
ttttttcacgctt

SEQ ID NO: 747071 - DNA, 13 bp, C. elegans
ttttttcacggaa

SEQ ID NO: 747072 - DNA, 13 bp, C. elegans
ttttttcactaaa

SEQ ID NO: 747073 - DNA, 13 bp, C. elegans
ttttttcactgat

SEQ ID NO: 747074 - DNA, 13 bp, C. elegans
ttttttcagaaaa

SEQ ID NO: 747075 - DNA, 13 bp, C. elegans
ttttttcagacaa

SEQ ID NO: 747076 - DNA, 13 bp, C. elegans
ttttttcagattg

SEQ ID NO: 747077 - DNA, 13 bp, C. elegans
ttttttcagcaaa

SEQ ID NO: 747078 - DNA, 13 bp, C. elegans
ttttttcaggaaa

SEQ ID NO: 747079 - DNA, 13 bp, C. elegans
ttttttcagtcga

SEQ ID NO: 747080 - DNA, 13 bp, C. elegans
ttttttcagtgtc

SEQ ID NO: 747081 - DNA, 13 bp, C. elegans
ttttttcagttaa

SEQ ID NO: 747082 - DNA, 13 bp, C. elegans
ttttttcatctgg

SEQ ID NO: 747083 - DNA, 13 bp, C. elegans
ttttttcatgaat

SEQ ID NO: 747084 - DNA, 13 bp, C. elegans
ttttttcattgaa

SEQ ID NO: 747085 - DNA, 13 bp, C. elegans
ttttttccaaaac

SEQ ID NO: 747086 - DNA, 13 bp, C. elegans
ttttttccaaagc

SEQ ID NO: 747087 - DNA, 15 bp, C. elegans
ttttttccacaaaaa

SEQ ID NO: 747088 - DNA, 13 bp, C. elegans
ttttttccacaat

SEQ ID NO: 747089 - DNA, 13 bp, C. elegans
ttttttccagtta

SEQ ID NO: 747090 - DNA, 13 bp, C. elegans
ttttttccatcaa

SEQ ID NO: 747091 - DNA, 13 bp, C. elegans
ttttttccatgaa

SEQ ID NO: 747092 - DNA, 17 bp, C. elegans
ttttttccccaattttt

SEQ ID NO: 747093 - DNA, 13 bp, C. elegans
ttttttccccaca

SEQ ID NO: 747094 - DNA, 13 bp, C. elegans
ttttttccgaaaa

SEQ ID NO: 747095 - DNA, 13 bp, C. elegans
ttttttccgcaaa

SEQ ID NO: 747096 - DNA, 13 bp, C. elegans
ttttttccggaat

SEQ ID NO: 747097 - DNA, 13 bp, C. elegans
ttttttcctcgaa

SEQ ID NO: 747098 - DNA, 13 bp, C. elegans
ttttttcctgaaa

SEQ ID NO: 747099 - DNA, 13 bp, C. elegans
ttttttcctgcaa

SEQ ID NO: 747100 - DNA, 13 bp, C. elegans
ttttttcgaaaaa

SEQ ID NO: 747101 - DNA, 14 bp, C. elegans
ttttttcgaaaaat

SEQ ID NO: 747102 - DNA, 13 bp, C. elegans
ttttttcgaaaac

SEQ ID NO: 747103 - DNA, 13 bp, C. elegans
ttttttcgaagga

SEQ ID NO: 747104 - DNA, 13 bp, C. elegans
ttttttcgacaaa

SEQ ID NO: 747105 - DNA, 13 bp, C. elegans
ttttttcgagaat

SEQ ID NO: 747106 - DNA, 13 bp, C. elegans
ttttttcgagcta

SEQ ID NO: 747107 - DNA, 13 bp, C. elegans
ttttttcgatcat

SEQ ID NO: 747108 - DNA, 13 bp, C. elegans
ttttttcgcagaa

SEQ ID NO: 747109 - DNA, 13 bp, C. elegans
ttttttcgccaaa

SEQ ID NO: 747110 - DNA, 13 bp, C. elegans
ttttttcgccaat

SEQ ID NO: 747111 - DNA, 13 bp, C. elegans
ttttttcgcgcaa

SEQ ID NO: 747112 - DNA, 13 bp, C. elegans
ttttttcgctaaa

SEQ ID NO: 747113 - DNA, 13 bp, C. elegans
ttttttcgctgat

SEQ ID NO: 747114 - DNA, 13 bp, C. elegans
ttttttcggaaac

SEQ ID NO: 747115 - DNA, 13 bp, C. elegans
ttttttcggataa

SEQ ID NO: 747116 - DNA, 13 bp, C. elegans
ttttttcggcaaa

SEQ ID NO: 747117 - DNA, 13 bp, C. elegans
ttttttcgggatt

SEQ ID NO: 747118 - DNA, 13 bp, C. elegans
ttttttctaaatg

SEQ ID NO: 747119 - DNA, 13 bp, C. elegans
ttttttctagata

SEQ ID NO: 747120 - DNA, 13 bp, C. elegans
ttttttctaggat

SEQ ID NO: 747121 - DNA, 13 bp, C. elegans
ttttttctcaaaa

SEQ ID NO: 747122 - DNA, 13 bp, C. elegans
ttttttctcaagc

SEQ ID NO: 747123 - DNA, 13 bp, C. elegans
ttttttctcaagt

SEQ ID NO: 747124 - DNA, 13 bp, C. elegans
ttttttctcagtg

SEQ ID NO: 747125 - DNA, 13 bp, C. elegans
ttttttctcatag

SEQ ID NO: 747126 - DNA, 13 bp, C. elegans
ttttttctccaaa

SEQ ID NO: 747127 - DNA, 13 bp, C. elegans
ttttttctcccaa

SEQ ID NO: 747128 - DNA, 13 bp, C. elegans
ttttttctcggaa

SEQ ID NO: 747129 - DNA, 13 bp, C. elegans
ttttttctctgaa

SEQ ID NO: 747130 - DNA, 13 bp, C. elegans
ttttttctgaaac

SEQ ID NO: 747131 - DNA, 13 bp, C. elegans
ttttttctgagct

SEQ ID NO: 747132 - DNA, 13 bp, C. elegans
ttttttctgataa

SEQ ID NO: 747133 - DNA, 13 bp, C. elegans
ttttttctgatca

SEQ ID NO: 747134 - DNA, 13 bp, C. elegans
ttttttctgcaga

SEQ ID NO: 747135 - DNA, 13 bp, C. elegans
ttttttctgccat

SEQ ID NO: 747136 - DNA, 13 bp, C. elegans
ttttttctgctga

SEQ ID NO: 747137 - DNA, 13 bp, C. elegans
ttttttctggaaa

SEQ ID NO: 747138 - DNA, 13 bp, C. elegans
ttttttctggaga

SEQ ID NO: 747139 - DNA, 13 bp, C. elegans
ttttttctgtaca

SEQ ID NO: 747140 - DNA, 13 bp, C. elegans
ttttttctgtgga

SEQ ID NO: 747141 - DNA, 13 bp, C. elegans
ttttttcttagaa

SEQ ID NO: 747142 - DNA, 13 bp, C. elegans
ttttttcttcaga

SEQ ID NO: 747143 - DNA, 13 bp, C. elegans
ttttttcttgaag

SEQ ID NO: 747144 - DNA, 13 bp, C. elegans
ttttttcttgagc

SEQ ID NO: 747145 - DNA, 13 bp, C. elegans
ttttttgaaaaag

SEQ ID NO: 747146 - DNA, 13 bp, C. elegans
ttttttgaaaatc

SEQ ID NO: 747147 - DNA, 13 bp, C. elegans
ttttttgaaagta

SEQ ID NO: 747148 - DNA, 13 bp, C. elegans
ttttttgaaatca

SEQ ID NO: 747149 - DNA, 13 bp, C. elegans
ttttttgaacaat

SEQ ID NO: 747150 - DNA, 13 bp, C. elegans
ttttttgaacata

SEQ ID NO: 747151 - DNA, 13 bp, C. elegans
ttttttgaactct

SEQ ID NO: 747152 - DNA, 13 bp, C. elegans
ttttttgaactta

SEQ ID NO: 747153 - DNA, 13 bp, C. elegans
ttttttgaagatc

SEQ ID NO: 747154 - DNA, 13 bp, C. elegans
ttttttgaagcga

SEQ ID NO: 747155 - DNA, 13 bp, C. elegans
ttttttgaataca

SEQ ID NO: 747156 - DNA, 13 bp, C. elegans
ttttttgaatatc

SEQ ID NO: 747157 - DNA, 14 bp, C. elegans
ttttttgaatcaaa

SEQ ID NO: 747158 - DNA, 13 bp, C. elegans
ttttttgaatcta

SEQ ID NO: 747159 - DNA, 13 bp, C. elegans
ttttttgaattgc

SEQ ID NO: 747160 - DNA, 13 bp, C. elegans
ttttttgacagtt

SEQ ID NO: 747161 - DNA, 13 bp, C. elegans
ttttttgacataa

SEQ ID NO: 747162 - DNA, 13 bp, C. elegans
ttttttgaccaaa

SEQ ID NO: 747163 - DNA, 13 bp, C. elegans
ttttttgagaaaa

SEQ ID NO: 747164 - DNA, 13 bp, C. elegans
ttttttgagaaat

SEQ ID NO: 747165 - DNA, 13 bp, C. elegans
ttttttgagaagt

SEQ ID NO: 747166 - DNA, 13 bp, C. elegans
ttttttgagacca

SEQ ID NO: 747167 - DNA, 13 bp, C. elegans
ttttttgagagaa

SEQ ID NO: 747168 - DNA, 13 bp, C. elegans
ttttttgagccgt

SEQ ID NO: 747169 - DNA, 13 bp, C. elegans
ttttttgagcgat

SEQ ID NO: 747170 - DNA, 13 bp, C. elegans
ttttttgataact

SEQ ID NO: 747171 - DNA, 13 bp, C. elegans
ttttttgattcaa

SEQ ID NO: 747172 - DNA, 13 bp, C. elegans
ttttttgcaaata

SEQ ID NO: 747173 - DNA, 13 bp, C. elegans
ttttttgcaaatc

SEQ ID NO: 747174 - DNA, 13 bp, C. elegans
ttttttgcaactt

SEQ ID NO: 747175 - DNA, 13 bp, C. elegans
ttttttgcaatat

SEQ ID NO: 747176 - DNA, 13 bp, C. elegans
ttttttgcaatta

SEQ ID NO: 747177 - DNA, 13 bp, C. elegans
ttttttgcaattg

SEQ ID NO: 747178 - DNA, 13 bp, C. elegans
ttttttgcacact

SEQ ID NO: 747179 - DNA, 13 bp, C. elegans
ttttttgcacatt

SEQ ID NO: 747180 - DNA, 13 bp, C. elegans
ttttttgcagaaa

SEQ ID NO: 747181 - DNA, 13 bp, C. elegans
ttttttgccaaaa

SEQ ID NO: 747182 - DNA, 13 bp, C. elegans
ttttttgccaaat

SEQ ID NO: 747183 - DNA, 13 bp, C. elegans
ttttttgccagtt

SEQ ID NO: 747184 - DNA, 13 bp, C. elegans
ttttttgccgaca

SEQ ID NO: 747185 - DNA, 13 bp, C. elegans
ttttttgcctgaa

SEQ ID NO: 747186 - DNA, 13 bp, C. elegans
ttttttgcgcgcc

SEQ ID NO: 747187 - DNA, 13 bp, C. elegans
ttttttgcggaaa

SEQ ID NO: 747188 - DNA, 13 bp, C. elegans
ttttttgctccaa

SEQ ID NO: 747189 - DNA, 13 bp, C. elegans
ttttttgctgcta

SEQ ID NO: 747190 - DNA, 13 bp, C. elegans
ttttttgctggaa

SEQ ID NO: 747191 - DNA, 13 bp, C. elegans
ttttttggaaaat

SEQ ID NO: 747192 - DNA, 13 bp, C. elegans
ttttttggaaact

SEQ ID NO: 747193 - DNA, 13 bp, C. elegans
ttttttggaaatg

SEQ ID NO: 747194 - DNA, 13 bp, C. elegans
ttttttggaacaa

SEQ ID NO: 747195 - DNA, 13 bp, C. elegans
ttttttggaactt

SEQ ID NO: 747196 - DNA, 13 bp, C. elegans
ttttttggaagaa

SEQ ID NO: 747197 - DNA, 13 bp, C. elegans
ttttttggaagct

SEQ ID NO: 747198 - DNA, 13 bp, C. elegans
ttttttggacaaa

SEQ ID NO: 747199 - DNA, 13 bp, C. elegans
ttttttggacgaa

SEQ ID NO: 747200 - DNA, 13 bp, C. elegans
ttttttggagaga

SEQ ID NO: 747201 - DNA, 13 bp, C. elegans
ttttttggagcac

SEQ ID NO: 747202 - DNA, 13 bp, C. elegans
ttttttggagcag

SEQ ID NO: 747203 - DNA, 13 bp, C. elegans
ttttttggatgaa

SEQ ID NO: 747204 - DNA, 13 bp, C. elegans
ttttttggcaaaa

SEQ ID NO: 747205 - DNA, 13 bp, C. elegans
ttttttggcaact

SEQ ID NO: 747206 - DNA, 13 bp, C. elegans
ttttttggcaagt

SEQ ID NO: 747207 - DNA, 13 bp, C. elegans
ttttttggcaata

SEQ ID NO: 747208 - DNA, 13 bp, C. elegans
ttttttggcataa

SEQ ID NO: 747209 - DNA, 13 bp, C. elegans
ttttttggcatat

SEQ ID NO: 747210 - DNA, 13 bp, C. elegans
ttttttggcgatt

SEQ ID NO: 747211 - DNA, 13 bp, C. elegans
ttttttgggaaaa

SEQ ID NO: 747212 - DNA, 13 bp, C. elegans
ttttttgggaata

SEQ ID NO: 747213 - DNA, 13 bp, C. elegans
ttttttgggataa

SEQ ID NO: 747214 - DNA, 13 bp, C. elegans
ttttttggtcaaa

SEQ ID NO: 747215 - DNA, 13 bp, C. elegans
ttttttggtccat

SEQ ID NO: 747216 - DNA, 13 bp, C. elegans
ttttttggtgaaa

SEQ ID NO: 747217 - DNA, 13 bp, C. elegans
ttttttggtgcaa

SEQ ID NO: 747218 - DNA, 13 bp, C. elegans
ttttttggtggaa

SEQ ID NO: 747219 - DNA, 13 bp, C. elegans
ttttttggttcga

SEQ ID NO: 747220 - DNA, 13 bp, C. elegans
ttttttgtaaaac

SEQ ID NO: 747221 - DNA, 13 bp, C. elegans
ttttttgtaaaca

SEQ ID NO: 747222 - DNA, 13 bp, C. elegans
ttttttgtaacta

SEQ ID NO: 747223 - DNA, 13 bp, C. elegans
ttttttgtaagaa

SEQ ID NO: 747224 - DNA, 13 bp, C. elegans
ttttttgtacaga

SEQ ID NO: 747225 - DNA, 13 bp, C. elegans
ttttttgtagaaa

SEQ ID NO: 747226 - DNA, 13 bp, C. elegans
ttttttgtagcaa

SEQ ID NO: 747227 - DNA, 13 bp, C. elegans
ttttttgtataca

SEQ ID NO: 747228 - DNA, 13 bp, C. elegans
ttttttgtcaaaa

SEQ ID NO: 747229 - DNA, 13 bp, C. elegans
ttttttgtcacaa

SEQ ID NO: 747230 - DNA, 13 bp, C. elegans
ttttttgtcagat

SEQ ID NO: 747231 - DNA, 13 bp, C. elegans
ttttttgtcataa

SEQ ID NO: 747232 - DNA, 13 bp, C. elegans
ttttttgtcgaaa

SEQ ID NO: 747233 - DNA, 13 bp, C. elegans
ttttttgtcgatc

SEQ ID NO: 747234 - DNA, 13 bp, C. elegans
ttttttgtctcaa

SEQ ID NO: 747235 - DNA, 13 bp, C. elegans
ttttttgtctcga

SEQ ID NO: 747236 - DNA, 13 bp, C. elegans
ttttttgtctgga

SEQ ID NO: 747237 - DNA, 13 bp, C. elegans
ttttttgtgaaaa

SEQ ID NO: 747238 - DNA, 13 bp, C. elegans
ttttttgtgaaac

SEQ ID NO: 747239 - DNA, 13 bp, C. elegans
ttttttgtgaaca

SEQ ID NO: 747240 - DNA, 13 bp, C. elegans
ttttttgtgaatc

SEQ ID NO: 747241 - DNA, 13 bp, C. elegans
ttttttgtgcaat

SEQ ID NO: 747242 - DNA, 13 bp, C. elegans
ttttttgtgccta

SEQ ID NO: 747243 - DNA, 13 bp, C. elegans
ttttttgtggaaa

SEQ ID NO: 747244 - DNA, 13 bp, C. elegans
ttttttgtgtaac

SEQ ID NO: 747245 - DNA, 13 bp, C. elegans
ttttttgttacag

SEQ ID NO: 747246 - DNA, 13 bp, C. elegans
ttttttgttcaag

SEQ ID NO: 747247 - DNA, 13 bp, C. elegans
ttttttgttgcag

SEQ ID NO: 747248 - DNA, 13 bp, C. elegans
tttttttaaaacc

SEQ ID NO: 747249 - DNA, 13 bp, C. elegans
tttttttaaagtc

SEQ ID NO: 747250 - DNA, 13 bp, C. elegans
tttttttaacgac

SEQ ID NO: 747251 - DNA, 13 bp, C. elegans
tttttttagtcaa

SEQ ID NO: 747252 - DNA, 13 bp, C. elegans
tttttttcaaacc

SEQ ID NO: 747253 - DNA, 13 bp, C. elegans
tttttttcaaacg

SEQ ID NO: 747254 - DNA, 13 bp, C. elegans
tttttttcaacaa

SEQ ID NO: 747255 - DNA, 14 bp, C. elegans
tttttttcacaaat

SEQ ID NO: 747256 - DNA, 13 bp, C. elegans
tttttttcaccga

SEQ ID NO: 747257 - DNA, 13 bp, C. elegans
tttttttcacctg

SEQ ID NO: 747258 - DNA, 13 bp, C. elegans
tttttttcactgg

SEQ ID NO: 747259 - DNA, 13 bp, C. elegans
tttttttcagaaa

SEQ ID NO: 747260 - DNA, 13 bp, C. elegans
tttttttcagtaa

SEQ ID NO: 747261 - DNA, 13 bp, C. elegans
tttttttcagtca

SEQ ID NO: 747262 - DNA, 13 bp, C. elegans
tttttttcagtga

SEQ ID NO: 747263 - DNA, 13 bp, C. elegans
tttttttccaaaa

SEQ ID NO: 747264 - DNA, 14 bp, C. elegans
tttttttccaaact

SEQ ID NO: 747265 - DNA, 13 bp, C. elegans
tttttttccaaca

SEQ ID NO: 747266 - DNA, 13 bp, C. elegans
tttttttccacaa

SEQ ID NO: 747267 - DNA, 13 bp, C. elegans
tttttttccagaa

SEQ ID NO: 747268 - DNA, 13 bp, C. elegans
tttttttccagat

SEQ ID NO: 747269 - DNA, 13 bp, C. elegans
tttttttccagta

SEQ ID NO: 747270 - DNA, 13 bp, C. elegans
tttttttcccaac

SEQ ID NO: 747271 - DNA, 13 bp, C. elegans
tttttttccccga

SEQ ID NO: 747272 - DNA, 13 bp, C. elegans
tttttttccgaaa

SEQ ID NO: 747273 - DNA, 13 bp, C. elegans
tttttttccgaat

SEQ ID NO: 747274 - DNA, 13 bp, C. elegans
tttttttcctgaa

SEQ ID NO: 747275 - DNA, 13 bp, C. elegans
tttttttcctgca

SEQ ID NO: 747276 - DNA, 15 bp, C. elegans
tttttttcgaaattt

SEQ ID NO: 747277 - DNA, 13 bp, C. elegans
tttttttcgacaa

SEQ ID NO: 747278 - DNA, 13 bp, C. elegans
tttttttcgctga

SEQ ID NO: 747279 - DNA, 14 bp, C. elegans
tttttttcggaaat

SEQ ID NO: 747280 - DNA, 13 bp, C. elegans
tttttttcggcga

SEQ ID NO: 747281 - DNA, 13 bp, C. elegans
tttttttcggtca

SEQ ID NO: 747282 - DNA, 13 bp, C. elegans
tttttttctaaag

SEQ ID NO: 747283 - DNA, 13 bp, C. elegans
tttttttctgaaa

SEQ ID NO: 747284 - DNA, 13 bp, C. elegans
tttttttctgaac

SEQ ID NO: 747285 - DNA, 13 bp, C. elegans
tttttttgaaaac

SEQ ID NO: 747286 - DNA, 16 bp, C. elegans
tttttttgaaaacttt

SEQ ID NO: 747287 - DNA, 13 bp, C. elegans
tttttttgaacca

SEQ ID NO: 747288 - DNA, 13 bp, C. elegans
tttttttgaagtc

SEQ ID NO: 747289 - DNA, 13 bp, C. elegans
tttttttgaatac

SEQ ID NO: 747290 - DNA, 13 bp, C. elegans
tttttttgacgaa

SEQ ID NO: 747291 - DNA, 13 bp, C. elegans
tttttttgagaaa

SEQ ID NO: 747292 - DNA, 13 bp, C. elegans
tttttttgagaga

SEQ ID NO: 747293 - DNA, 13 bp, C. elegans
tttttttgaggaa

SEQ ID NO: 747294 - DNA, 13 bp, C. elegans
tttttttgcaaaa

SEQ ID NO: 747295 - DNA, 13 bp, C. elegans
tttttttgcacaa

SEQ ID NO: 747296 - DNA, 13 bp, C. elegans
tttttttgcagaa

SEQ ID NO: 747297 - DNA, 13 bp, C. elegans
tttttttgcataa

SEQ ID NO: 747298 - DNA, 13 bp, C. elegans
tttttttgcatca

SEQ ID NO: 747299 - DNA, 13 bp, C. elegans
tttttttgccaat

SEQ ID NO: 747300 - DNA, 13 bp, C. elegans
tttttttgccaca

SEQ ID NO: 747301 - DNA, 13 bp, C. elegans
tttttttgcccaa

SEQ ID NO: 747302 - DNA, 13 bp, C. elegans
tttttttgcccta

SEQ ID NO: 747303 - DNA, 13 bp, C. elegans
tttttttgcgata

SEQ ID NO: 747304 - DNA, 13 bp, C. elegans
tttttttgctaaa

SEQ ID NO: 747305 - DNA, 13 bp, C. elegans
tttttttgctcaa

SEQ ID NO: 747306 - DNA, 13 bp, C. elegans
tttttttgctgaa

SEQ ID NO: 747307 - DNA, 15 bp, C. elegans
tttttttggaaaata

SEQ ID NO: 747308 - DNA, 13 bp, C. elegans
tttttttggagaa

SEQ ID NO: 747309 - DNA, 13 bp, C. elegans
tttttttggcaac

SEQ ID NO: 747310 - DNA, 13 bp, C. elegans
tttttttggcgaa

SEQ ID NO: 747311 - DNA, 13 bp, C. elegans
tttttttggtcga

SEQ ID NO: 747312 - DNA, 13 bp, C. elegans
tttttttgtcaaa

SEQ ID NO: 747313 - DNA, 13 bp, C. elegans
tttttttgtgcaa

SEQ ID NO: 747314 - DNA, 13 bp, C. elegans
ttttttttagaac

SEQ ID NO: 747315 - DNA, 13 bp, C. elegans
ttttttttcaaga

SEQ ID NO: 747316 - DNA, 13 bp, C. elegans
ttttttttcagaa

SEQ ID NO: 747317 - DNA, 13 bp, C. elegans
ttttttttcagga

SEQ ID NO: 747318 - DNA, 13 bp, C. elegans
ttttttttccaga

SEQ ID NO: 747319 - DNA, 13 bp, C. elegans
ttttttttcgaaa

SEQ ID NO: 747320 - DNA, 16 bp, C. elegans
ttttttttcgaacttt

SEQ ID NO: 747321 - DNA, 13 bp, C. elegans
ttttttttgacaa

SEQ ID NO: 747322 - DNA, 13 bp, C. elegans
ttttttttgcaaa

SEQ ID NO: 747323 - DNA, 13 bp, C. elegans
ttttttttgcagg

SEQ ID NO: 747324 - DNA, 13 bp, C. elegans
ttttttttgccag

SEQ ID NO: 747325 - DNA, 14 bp, C. elegans
ttttttttggcaaa

SEQ ID NO: 747326 - DNA, 13 bp, C. elegans
ttttttttggcga

SEQ ID NO: 747327 - DNA, 18 bp, Unknown
  The pattern is a representation of an 18-nucleotide core motif presently assumed to be present in all variations of the logical unit which appears several times in the intergenic/intronic regions of the human genome.
tcccataccacggggatt

SEQ ID NO: 747328 - DNA, 18 bp, Unknown
  The pattern is a representation of a core pattern presently assumed to be present in all variations of the logical unit which appears several times in the intergenic/intronic regions of the human genome.
tcccataccacggggatt

SEQ ID NO: 747329 - DNA, 19 bp, Unknown
  The pattern is a representation of a core pattern presently assumed to be present in all variations of the logical unit which appears several times in the intergenic/intronic regions of the human genome.
tcccataccacggggatta

SEQ ID NO: 747330 - DNA, 19 bp, Unknown
  The pattern is a representation of a core pattern presently assumed to be present in all variations of the logical unit which appears several times in the intergenic/intronic regions of the human genome.
ctcccataccacggggatt

SEQ ID NO: 747331 - DNA, 20 bp, Unknown
  The pattern is a representation of a core pattern presently assumed to be present in all variations of the logical unit which appears several times in the intergenic/intronic regions of the human genome.
ctcccataccacggggatta

SEQ ID NO: 747332 - DNA, 20 bp, Unknown
  The pattern is a representation of a core pattern presently assumed to be present in all variations of the logical unit which appears several times in the intergenic/intronic regions of the human genome.
tcccataccacggggattac

SEQ ID NO: 747333 - DNA, 21 bp, Unknown
  The pattern is a representation of a core pattern presently assumed to be present in all variations of the logical unit which appears several times in the intergenic/intronic regions of the human genome.
gcctcccataccacggggatt

SEQ ID NO: 747334 - DNA, 21 bp, Unknown
  The pattern is a representation of a core pattern presently assumed to be present in all variations of the logical unit which appears several times in the intergenic/intronic regions of the human genome.
tcccataccacggggattaca

SEQ ID NO: 747335 - DNA, 22 bp, Unknown
  The pattern is a representation of a core pattern presently assumed to be present in all variations of the logical unit which appears several times in the intergenic/intronic regions of the human genome.
gcctcccataccacggggatta

SEQ ID NO: 747336 - DNA, 24 bp, Unknown
  The pattern is a representation of a core pattern presently assumed to be present in all variations of the logical unit which appears several times in the intergenic/intronic regions of the human genome.
gcctcccataccacggggattaca

SEQ ID NO: 747337 - DNA, 23 bp, Unknown
  The pattern is a representation of a core pattern presently assumed to be present in all variations of the logical unit which appears several times in the intergenic/intronic regions of the human genome.
ggcctcccataccacggggatta

SEQ ID NO: 747338 - DNA, 16 bp, Unknown
  The pattern is an example of a pyknon.
tgcactccagcctggg

SEQ ID NO: 747339 - DNA, 19 bp, Unknown
  The pattern is an example of a pyknon.
taatcccagcactttggga

SEQ ID NO: 747340 - DNA, 17 bp, Unknown
  The pattern is an example of a pyknon.
ggctgaggcaggagaat

SEQ ID NO: 747341 - DNA, 16 bp, Unknown
  The pattern is an example of a pyknon.
gaggttgcagtgagcc

SEQ ID NO: 747342 - DNA, 1748 bp, Unknown
  The pattern is a combinatorial arrangement of pyknons in 3'UTRs.
  misc_feature: n indicates the number of nucleotides separating the pyknons that surround it, as specified by Figure 11A.
  misc_feature (1)..(1): n is a, c, g, or t
  misc_feature (18)..(18): n is a, c, g, or t
  misc_feature (35)..(35): n is a, c, g, or t
  misc_feature (52)..(52): n is a, c, g, or t
  misc_feature (69)..(69): n is a, c, g, or t
  misc_feature (86)..(86): n is a, c, g, or t
  misc_feature (103)..(103): n is a, c, g, or t
  misc_feature (120)..(120): n is a, c, g, or t
  misc_feature (137)..(137): n is a, c, g, or t
  misc_feature (154)..(154): n is a, c, g, or t
  misc_feature (174)..(174): n is a, c, g, or t
  misc_feature (191)..(191): n is a, c, g, or t
  misc_feature (208)..(208): n is a, c, g, or t
  misc_feature (225)..(225): n is a, c, g, or t
  misc_feature (242)..(242): n is a, c, g, or t
  misc_feature (260)..(260): n is a, c, g, or t
  misc_feature (278)..(278): n is a, c, g, or t
  misc_feature (295)..(295): n is a, c, g, or t
  misc_feature (312)..(312): n is a, c, g, or t
  misc_feature (348)..(348): n is a, c, g, or t
  misc_feature (365)..(365): n is a, c, g, or t
  misc_feature (382)..(382): n is a, c, g, or t
  misc_feature (418)..(418): n is a, c, g, or t
  misc_feature (436)..(436): n is a, c, g, or t
  misc_feature (455)..(455): n is a, c, g, or t
  misc_feature (472)..(472): n is a, c, g, or t
  misc_feature (490)..(490): n is a, c, g, or t
  misc_feature (508)..(508): n is a, c, g, or t
  misc_feature (543)..(543): n is a, c, g, or t
  misc_feature (560)..(560): n is a, c, g, or t
  misc_feature (577)..(577): n is a, c, g, or t
  misc_feature (594)..(594): n is a, c, g, or t
  misc_feature (611)..(611): n is a, c, g, or t
  misc_feature (628)..(628): n is a, c, g, or t
  misc_feature (664)..(664): n is a, c, g, or t
  misc_feature (685)..(685): n is a, c, g, or t
  misc_feature (702)..(702): n is a, c, g, or t
  misc_feature (719)..(719): n is a, c, g, or t
  misc_feature (737)..(737): n is a, c, g, or t
  misc_feature (755)..(755): n is a, c, g, or t
  misc_feature (772)..(772): n is a, c, g, or t
  misc_feature (789)..(789): n is a, c, g, or t
  misc_feature (822)..(822): n is a, c, g, or t
  misc_feature (839)..(839): n is a, c, g, or t
  misc_feature (856)..(856): n is a, c, g, or t
  misc_feature (889)..(889): n is a, c, g, or t
  misc_feature (906)..(906): n is a, c, g, or t
  misc_feature (923)..(923): n is a, c, g, or t
  misc_feature (940)..(940): n is a, c, g, or t
  misc_feature (957)..(957): n is a, c, g, or t
  misc_feature (974)..(974): n is a, c, g, or t
  misc_feature (991)..(991): n is a, c, g, or t
  misc_feature (1008)..(1008): n is a, c, g, or t
  misc_feature (1025)..(1025): n is a, c, g, or t
  misc_feature (1042)..(1042): n is a, c, g, or t
  misc_feature (1059)..(1059): n is a, c, g, or t
  misc_feature (1076)..(1076): n is a, c, g, or t
  misc_feature (1096)..(1096): n is a, c, g, or t
  misc_feature (1113)..(1113): n is a, c, g, or t
  misc_feature (1130)..(1130): n is a, c, g, or t
  misc_feature (1147)..(1147): n is a, c, g, or t
  misc_feature (1164)..(1164): n is a, c, g, or t
  misc_feature (1181)..(1181): n is a, c, g, or t
  misc_feature (1198)..(1198): n is a, c, g, or t
  misc_feature (1215)..(1215): n is a, c, g, or t
  misc_feature (1232)..(1232): n is a, c, g, or t
  misc_feature (1265)..(1265): n is a, c, g, or t
  misc_feature (1282)..(1282): n is a, c, g, or t
  misc_feature (1319)..(1319): n is a, c, g, or t
  misc_feature (1336)..(1336): n is a, c, g, or t
  misc_feature (1353)..(1353): n is a, c, g, or t
  misc_feature (1389)..(1389): n is a, c, g, or t
  misc_feature (1406)..(1406): n is a, c, g, or t
  misc_feature (1427)..(1427): n is a, c, g, or t
  misc_feature (1468)..(1468): n is a, c, g, or t
  misc_feature (1488)..(1488): n is a, c, g, or t
  misc_feature (1505)..(1505): n is a, c, g, or t
  misc_feature (1526)..(1526): n is a, c, g, or t
  misc_feature (1543)..(1543): n is a, c, g, or t
  misc_feature (1560)..(1560): n is a, c, g, or t
  misc_feature (1577)..(1577): n is a, c, g, or t
  misc_feature (1595)..(1595): n is a, c, g, or t
  misc_feature (1612)..(1612): n is a, c, g, or t
  misc_feature (1629)..(1629): n is a, c, g, or t
  misc_feature (1646)..(1646): n is a, c, g, or t
  misc_feature (1663)..(1663): n is a, c, g, or t
  misc_feature (1680)..(1680): n is a, c, g, or t
  misc_feature (1697)..(1697): n is a, c, g, or t
  misc_feature (1714)..(1714): n is a, c, g, or t
  misc_feature (1731)..(1731): n is a, c, g, or t
  misc_feature (1748)..(1748): n is a, c, g, or t
ntttcttgatttttcagnatactgatttaatttcnattttcttttaaagttnactgacatggaaagatntgtattacttttgtaanatttttagaaagtattntggatgaaaaatatttnctcacaacaaacctatnattcatttaaaacattnctttttgagatggagtcttncccaggctggagtgcanatctctgctcactgcangccttctgggttcaagnattctcgtgcctcagcnagtagctggaattacagngccaccatgcccgactanttggccaggctggtatnaactcctgacctcaagntcccaaagtgctgggattacaggcttgagccaccanttattttacattttagnaaatttgtattttgaancagtggctcacgcctgtaatcccagcactttgggangatcacgaggtcaggagnagaccatcctggctaacantctctactaaaaaacanttagccgggcgtggtggnctgtagtcccagctactnggctgaggcaggagaatggtgtgaacccgggaggngagcttgcagtgagccntgcactccagcctgggnagagcaagactctgtcntctgtgaaaggaaaatnactcccatcctaatacncggtggctcatgcctgtaatcccagcactttgggangatcacctgaggtcgggaggnagaccagcctgaccaanttagctgggcgtggtgnctgtaatcccagctactnggctgaggcaggagaatncttgaacccaggaggcngaggttgtggtgagcgntgcactccagcctgggcaacaagagcaaaactnttagccaggcgtggtgngcagctactctggaggnagaggcaggaggatcacttgagcccatgaattngaggcagcagtgagctntgtactccagtctgggnacagagtgagaccccanttgaaaagattattctntcattttacaggtgagnccatggattcaaccaanctgttgttaagcaacantaacaactatttacatnagcaattatttttaaanattgtattaggtattanccagcctggacaaaagnaaaccctgtctctacaaaanttagctgggcatggtgntgtagtcctggctactnggaggatcgcttgagtngaggctgcattgagctntgcattccagcctgggnagaccttgtctcagaanattatatgcaaatactncagtctcactgtgttgnggatggagtgcaatggcacaatcttggctcatncagctgggactacaggngtgcccagttaattttttttgtattcttagtagaganttggccaggctagtctnaatttctgacctcaagntcccaaagtgctgggattacaggcgtgagccaccanttgaccaggctggtctnaactcctgatctcaggtgatnctcggcctcacaaagtgctgggattacaggtgtgaaccacnggcacggtggctcacgcctnccgaggctgaggcaggnctcacctgaggtcaggagttnagaccagcctggccaancctgtctgtacaaaaanatagctgggcatggtgnctgtagtcccagctactnactgaggcaggagaatncttgaacctgggaggcngaggttgcagggagccncgcactccagcctaggngatagagtgagactccnatgttttgagacagagngaaaactaagaaaattnttatttttctgtgaatncaataaaatactattcn

SEQ ID NO: 747343 - DNA, 603 bp, Unknown
  The pattern is a combinatorial arrangement of pyknons in 3'UTRs.
  misc_feature: n indicates the number of nucleotides separating the pyknons that surround it, as specified by Figure 11B.
  misc_feature (1)..(1): n is a, c, g, or t
  misc_feature (18)..(18): n is a, c, g, or t
  misc_feature (38)..(38): n is a, c, g, or t
  misc_feature (59)..(59): n is a, c, g, or t
  misc_feature (76)..(76): n is a, c, g, or t
  misc_feature (94)..(94): n is a, c, g, or t
  misc_feature (112)..(112): n is a, c, g, or t
  misc_feature (130)..(130): n is a, c, g, or t
  misc_feature (147)..(147): n is a, c, g, or t
  misc_feature (164)..(164): n is a, c, g, or t
  misc_feature (181)..(181): n is a, c, g, or t
  misc_feature (198)..(198): n is a, c, g, or t
  misc_feature (234)..(234): n is a, c, g, or t
  misc_feature (252)..(252): n is a, c, g, or t
  misc_feature (271)..(271): n is a, c, g, or t
  misc_feature (288)..(288): n is a, c, g, or t
  misc_feature (305)..(305): n is a, c, g, or t
  misc_feature (322)..(322): n is a, c, g, or t
  misc_feature (339)..(339): n is a, c, g, or t
  misc_feature (356)..(356): n is a, c, g, or t
  misc_feature (373)..(373): n is a, c, g, or t
  misc_feature (390)..(390): n is a, c, g, or t
  misc_feature (410)..(410): n is a, c, g, or t
  misc_feature (448)..(448): n is a, c, g, or t
  misc_feature (466)..(466): n is a, c, g, or t
  misc_feature (483)..(483): n is a, c, g, or t
  misc_feature (500)..(500): n is a, c, g, or t
  misc_feature (518)..(518): n is a, c, g, or t
  misc_feature (535)..(535): n is a, c, g, or t
  misc_feature (552)..(552): n is a, c, g, or t
  misc_feature (569)..(569): n is a, c, g, or t
  misc_feature (586)..(586): n is a, c, g, or t
  misc_feature (603)..(603): n is a, c, g, or t
ngccaggtatggtggctntaatcccagcactttggganatcacctgatgtcaggagttnagaccagcctggccaanactagccaggcgtggtgnctgtaatcccagctactnggctgaggcaggagaatncttgaacccaggaggcngaggttgcagtgagccncactgcactccagcccngtgacagtgtgagactncggtggctcaagcctgtaatcccagcactttgggangatcacgaggtcaggagnagaccatcctggctaacantagtcgggcgtggtggncctgtattcacagctangaggttgaggcaggagngggtgaacccgggaggngagcttgcagtgagccntgcactccagcctgggngacagagccagactccnaggctcacacctgtaatccngacgctgaggtgggaggatcacttgagcccaggagttntgggcaatatagtgaganctacaaaaaagtttttnagcatggtggcacatgnctgtagtcccacctactnagggtcacctgagcctngaggctgcagtgagccntgcactccagcctgggnagagtaagaccctgtcnttttattgagcagtttn

SEQ ID NO: 747344 - DNA, 1070 bp, Unknown
  The pattern is a combinatorial arrangement of pyknons in 3'UTRs.
  misc_feature: n indicates the number of nucleotides separating the pyknons that surround it, as specified by Figure 11B.
  misc_feature (1)..(1): n is a, c, g, or t
  misc_feature (18)..(18): n is a, c, g, or t
  misc_feature (36)..(36): n is a, c, g, or t
  misc_feature (56)..(56): n is a, c, g, or t
  misc_feature (74)..(74): n is a, c, g, or t
  misc_feature (118)..(118): n is a, c, g, or t
  misc_feature (135)..(135): n is a, c, g, or t
  misc_feature (152)..(152): n is a, c, g, or t
  misc_feature (169)..(169): n is a, c, g, or t
  misc_feature (186)..(186): n is a, c, g, or t
  misc_feature (203)..(203): n is a, c, g, or t
  misc_feature (220)..(220): n is a, c, g, or t
  misc_feature (237)..(237): n is a, c, g, or t
  misc_feature (254)..(254): n is a, c, g, or t
  misc_feature (271)..(271): n is a, c, g, or t
  misc_feature (291)..(291): n is a, c, g, or t
  misc_feature (324)..(324): n is a, c, g, or t
  misc_feature (341)..(341): n is a, c, g, or t
  misc_feature (359)..(359): n is a, c, g, or t
  misc_feature (377)..(377): n is a, c, g, or t
  misc_feature (394)..(394): n is a, c, g, or t
  misc_feature (411)..(411): n is a, c, g, or t
  misc_feature (428)..(428): n is a, c, g, or t
  misc_feature (445)..(445): n is a, c, g, or t
  misc_feature (462)..(462): n is a, c, g, or t
  misc_feature (479)..(479): n is a, c, g, or t
  misc_feature (496)..(496): n is a, c, g, or t
  misc_feature (513)..(513): n is a, c, g, or t
  misc_feature (530)..(530): n is a, c, g, or t
  misc_feature (547)..(547): n is a, c, g, or t
  misc_feature (564)..(564): n is a, c, g, or t
  misc_feature (581)..(581): n is a, c, g, or t
  misc_feature (598)..(598): n is a, c, g, or t
  misc_feature (615)..(615): n is a, c, g, or t
  misc_feature (632)..(632): n is a, c, g, or t
  misc_feature (649)..(649): n is a, c, g, or t
  misc_feature (685)..(685): n is a, c, g, or t
  misc_feature (704)..(704): n is a, c, g, or t
  misc_feature (721)..(721): n is a, c, g, or t
  misc_feature (739)..(739): n is a, c, g, or t
  misc_feature (757)..(757): n is a, c, g, or t
  misc_feature (776)..(776): n is a, c, g, or t
  misc_feature (793)..(793): n is a, c, g, or t
  misc_feature (810)..(810): n is a, c, g, or t
  misc_feature (827)..(827): n is a, c, g, or t
  misc_feature (845)..(845): n is a, c, g, or t
  misc_feature (862)..(862): n is a, c, g, or t
  misc_feature (879)..(879): n is a, c, g, or t
  misc_feature (896)..(896): n is a, c, g, or t
  misc_feature (913)..(913): n is a, c, g, or t
  misc_feature (930)..(930): n is a, c, g, or t
  misc_feature (947)..(947): n is a, c, g, or t
  misc_feature (964)..(964): n is a, c, g, or t
  misc_feature (997)..(997): n is a, c, g, or t
  misc_feature (1016)..(1016): n is a, c, g, or t
  misc_feature (1034)..(1034): n is a, c, g, or t
  misc_feature (1070)..(1070): n is a, c, g, or t
naaagaagatcattttgnagcagtggctcacacctntaatcccagcactttggganaggtgggcggatcacccnaaaccagcctgaccaacatggtgaaaccctgtctctactaaatnttagcggggtgtggtgngcacctgtaatcgcagngaggctgagacaggagncttgaaccctagaggcngagtttgcagtgagccnccattgtactccagctnagtaagactctgtctcntgggagtcatccttganggccaggcatggtggcntaatcccagcattttgggantgaggtcaggagctcaagaccagcctggccaantagtcgggcgtggtggnctgtaatcccagctactnggctgaggcaggagaatncttgaacctgggaggcngaggttgcagtgagccntgtactccagcctgggnagtgagactctgtcttnctgataaatattgatgncagctccactaggaagnccattcaattccatttngagctctttgaggccancctagcacatagtaggntgaatgaatgaatgaantcattttatgaagctanttttatcagaaaaaaanacttaatccccagtgtnacaaaggaatgaagagnagcatttaggccatttnaaatggtatttagaaancggtggctcatgcctgtaatcccagcactttgggantgaggcaggcggatcactnagaccagcctggccaanttagccgggcgtggtggnctgtaatcccagctactnaggctgaggcaggagaaancctgaacccagaaggcngaggttgcagtgagccncactgcactccagccgncctctgtctcaaaaaaantttctttatctgtaaangtttagaaagtaaaaancccaggttggagtgcanggctcactgcaacctcngcctcccgggttcaagnctcctgtctcagcctcngagtacctgggactacngcccggctaattttttgtatttgtagtagagantgttagccaggatggtctnctcctgacctcatgatcntcccaaagtgctgggattacaggcgtgagcccccgn

SEQ ID NO: 747345 - DNA, 723 bp, Unknown
  The pattern is a combinatorial arrangement of pyknons in 3'UTRs.
  misc_feature: n indicates the number of nucleotides separating the pyknons that surround it, as specified by Figure 11B.
  misc_feature (1)..(1): n is a, c, g, or t
  misc_feature (18)..(18): n is a, c, g, or t
  misc_feature (35)..(35): n is a, c, g, or t
  misc_feature (54)..(54): n is a, c, g, or t
  misc_feature (73)..(73): n is a, c, g, or t
  misc_feature (90)..(90): n is a, c, g, or t
  misc_feature (107)..(107): n is a, c, g, or t
  misc_feature (126)..(126): n is a, c, g, or t
  misc_feature (143)..(143): n is a, c, g, or t
  misc_feature (160)..(160): n is a, c, g, or t
  misc_feature (177)..(177): n is a, c, g, or t
  misc_feature (194)..(194): n is a, c, g, or t
  misc_feature (211)..(211): n is a, c, g, or t
  misc_feature (228)..(228): n is a, c, g, or t
  misc_feature (245)..(245): n is a, c, g, or t
  misc_feature (262)..(262): n is a, c, g, or t
  misc_feature (279)..(279): n is a, c, g, or t
  misc_feature (316)..(316): n is a, c, g, or t
  misc_feature (333)..(333): n is a, c, g, or t
  misc_feature (350)..(350): n is a, c, g, or t
  misc_feature (367)..(367): n is a, c, g, or t
  misc_feature (385)..(385): n is a, c, g, or t
  misc_feature (402)..(402): n is a, c, g, or t
  misc_feature (435)..(435): n is a, c, g, or t
  misc_feature (452)..(452): n is a, c, g, or t
  misc_feature (469)..(469): n is a, c, g, or t
  misc_feature (505)..(505): n is a, c, g, or t
  misc_feature (526)..(526): n is a, c, g, or t
  misc_feature (543)..(543): n is a, c, g, or t
  misc_feature (564)..(564): n is a, c, g, or t
  misc_feature (581)..(581): n is a, c, g, or t
  misc_feature (602)..(602): n is a, c, g, or t
  misc_feature (619)..(619): n is a, c, g, or t
  misc_feature (636)..(636): n is a, c, g, or t
  misc_feature (654)..(654): n is a, c, g, or t
  misc_feature (672)..(672): n is a, c, g, or t
  misc_feature (689)..(689): n is a, c, g, or t
  misc_feature (706)..(706): n is a, c, g, or t
  misc_feature (723)..(723): n is a, c, g, or t
ncctgttgtggggagggncggtggctcatgcctgncatcccagcactttggganaacctgaggtcaggagttnaacaacatggtgaaacntgcctgcctgtaatccngaggctgaggcaggaaaancttgaacccgaaaggcngaggttgcagtgtgccncactgaactccagcctncaacaagagtgaaactntattgaacacttactanggcagagccaggatttntgttttttaaaaagaantttacagacaaggaaanggccaggcatggtggcntaatcccagcagtttgggaggctgaggtgggaggagnagaccagcctaggcaancccatctctacaaaaanttatctgggcctggtgnctgtagtcccagctactnagaggctgaggtgggancttgagcccagaagttgaggctgcagtgagccntgtactccagcctgggncaaagcaaaaccctgtncggtggctcacacctgtaatcccaacactttggganatcacctgaggtcaggagttnagaccagcctggccaancctctactgaaaatacaaaangcattgtggcacatgcnatcacctgaggtcaggagttnagaccagcctggccaanttagctgggcgtggtgnctgtagtcccagctactnggctgaggcaggagaatncttgaacctgggaggtngaggttgcagtaagccntgcactccagcctgggn

SEQ ID NO: 747346 - DNA, 826 bp, Unknown
  The pattern is a combinatorial arrangement of pyknons in 3'UTRs.
  misc_feature: n indicates the number of nucleotides separating the pyknons that surround it, as specified by Figure 11B.
  misc_feature (1)..(1): n is a, c, g, or t
  misc_feature (18)..(18): n is a, c, g, or t
  misc_feature (35)..(35): n is a, c, g, or t
  misc_feature (52)..(52): n is a, c, g, or t
  misc_feature (69)..(69): n is a, c, g, or t
  misc_feature (102)..(102): n is a, c, g, or t
  misc_feature (119)..(119): n is a, c, g, or t
  misc_feature (152)..(152): n is a, c, g, or t
  misc_feature (204)..(204): n is a, c, g, or t
  misc_feature (224)..(224): n is a, c, g, or t
  misc_feature (241)..(241): n is a, c, g, or t
  misc_feature (258)..(258): n is a, c, g, or t
  misc_feature (276)..(276): n is a, c, g, or t
  misc_feature (293)..(293): n is a, c, g, or t
  misc_feature (310)..(310): n is a, c, g, or t
  misc_feature (327)..(327): n is a, c, g, or t
  misc_feature (344)..(344): n is a, c, g, or t
  misc_feature (361)..(361): n is a, c, g, or t
  misc_feature (378)..(378): n is a, c, g, or t
  misc_feature (395)..(395): n is a, c, g, or t
  misc_feature (412)..(412): n is a, c, g, or t
  misc_feature (429)..(429): n is a, c, g, or t
  misc_feature (446)..(446): n is a, c, g, or t
  misc_feature (463)..(463): n is a, c, g, or t
  misc_feature (480)..(480): n is a, c, g, or t
  misc_feature (497)..(497): n is a, c, g, or t
  misc_feature (514)..(514): n is a, c, g, or t
  misc_feature (532)..(532): n is a, c, g, or t
  misc_feature (549)..(549): n is a, c, g, or t
  misc_feature (566)..(566): n is a, c, g, or t
  misc_feature (583)..(583): n is a, c, g, or t
  misc_feature (600)..(600): n is a, c, g, or t
  misc_feature (617)..(617): n is a, c, g, or t
  misc_feature (634)..(634): n is a, c, g, or t
  misc_feature (670)..(670): n is a, c, g, or t
  misc_feature (689)..(689): n is a, c, g, or t
  misc_feature (706)..(706): n is a, c, g, or t
  misc_feature (723)..(723): n is a, c, g, or t
  misc_feature (741)..(741): n is a, c, g, or t
  misc_feature (759)..(759): n is a, c, g, or t
  misc_feature (776)..(776): n is a, c, g, or t
  misc_feature (793)..(793): n is a, c, g, or t
  misc_feature (826)..(826): n is a, c, g, or t
nactgtactgtatttatnatattttacagaaatanttattcatttgtttaancagtggctcatgcctgngctgaggcaggaggacagtttgaggccaggagnagactagcctggacaantctctacaaaaacataaaaataaattagctggnaaaaataggctgggtgtggtggttcatgcctgtaatcctagcactttggganggatcacctgaggtcaggtncccaatatggtgaaacntagccaggtgtggtggnctgtagtcccagctactngaggctgacacaggagncttgaacccaggaagtngaggctgcagtgagccntgcactccagcctgggnagtgagactctgtctcngtgtggtggcatgtgtntgtggtcccagctactnccagaaggtcaaggctntgagctgtgattgcatntgcactccagcctgggnagcaagaccctatctcnaatttacaatttacaanctgaagaactttctttnattttgtttctaaatanagagatggggtctcgctncccaggctggagtgcantagctcactgcagtctnaaatgcatttttaaaantttctgattaataaatntgtatgtgccacatttncacacacacatgtgtgncagtggctcacgcctgtaatcccagcactttggganaacctgaggtcaggagttnagaccagcctgaccaanttagccaggcatggtgnctgtaatcccagctactnggctgaggcaggagaatncttgaacccgggaggcngaggttgcagttagccntgcactccagcctgggcaacaagagtaaaactn

SEQ ID NO: 747347 - DNA, 730 bp, Unknown
  The pattern is a combinatorial arrangement of pyknons in 3'UTRs.
  misc_feature: n indicates the number of nucleotides separating the pyknons that surround it, as specified by Figure 11B.
  misc_feature (1)..(1): n is a, c, g, or t
  misc_feature (18)..(18): n is a, c, g, or t
  misc_feature (35)..(35): n is a, c, g, or t
  misc_feature (52)..(52): n is a, c, g, or t
  misc_feature (88)..(88): n is a, c, g, or t
  misc_feature (109)..(109): n is a, c, g, or t
  misc_feature (126)..(126): n is a, c, g, or t
  misc_feature (143)..(143): n is a, c, g, or t
  misc_feature (161)..(161): n is a, c, g, or t
  misc_feature (179)..(179): n is a, c, g, or t
  misc_feature (196)..(196): n is a, c, g, or t
  misc_feature (213)..(213): n is a, c, g, or t
  misc_feature (230)..(230): n is a, c, g, or t
  misc_feature (247)..(247): n is a, c, g, or t
  misc_feature (264)..(264): n is a, c, g, or t
  misc_feature (281)..(281): n is a, c, g, or t
  misc_feature (298)..(298): n is a, c, g, or t
  misc_feature (315)..(315): n is a, c, g, or t
  misc_feature (332)..(332): n is a, c, g, or t
  misc_feature (349)..(349): n is a, c, g, or t
  misc_feature (401)..(401): n is a, c, g, or t
  misc_feature (418)..(418): n is a, c, g, or t
  misc_feature (435)..(435): n is a, c, g, or t
  misc_feature (452)..(452): n is a, c, g, or t
  misc_feature (469)..(469): n is a, c, g, or t
  misc_feature (486)..(486): n is a, c, g, or t
  misc_feature (503)..(503): n is a, c, g, or t
  misc_feature (520)..(520): n is a, c, g, or t
  misc_feature (537)..(537): n is a, c, g, or t
  misc_feature (554)..(554): n is a, c, g, or t
  misc_feature (571)..(571): n is a, c, g, or t
  misc_feature (592)..(592): n is a, c, g, or t
  misc_feature (609)..(609): n is a, c, g, or t
  misc_feature (626)..(626): n is a, c, g, or t
  misc_feature (644)..(644): n is a, c, g, or t
  misc_feature (662)..(662): n is a, c, g, or t
  misc_feature (679)..(679): n is a, c, g, or t
  misc_feature (696)..(696): n is a, c, g, or t
  misc_feature (713)..(713): n is a, c, g, or t
  misc_feature (730)..(730): n is a, c, g, or t
ncacacacacacccctgnaattgttttttctaatnctttttgaatttttaancagtggcccatgcctgtaatcccagcactttggggnatcacctgaggacaggagttnagaccagtctggccaantagccgggcatggtggnctgtaatcccagctactnggctgaggcaggagaatncttgaacctaggaggcngaggttgcagtgagccntgcactccagcctgggngacaagagtgaaactcntttgaattaatttttcngcctctaaaactgtgangcatcagaatcacctgnagggcttgttaaaacanacatttattgagctccnagggcagaggaaacaancaatggctcatgcctgtaatcccaacactttgggaggccaaggtgggagganagaccagcctggacaanagtgagatcctatctcnttagccaggcatggtgncctatagtcctggctangctgaggcaggaggatnaggctgcagtaagccangccactgcactcagccnagcaagaccctgtctcntctgggctgggcacagncacactttgggaggccnatcacctgaggtcaggagttnagaccagcctggccaanttagctgggcgtggtgnctgtaatcccagctactnggctgaggcaggagaatncttgaacccaggaggcngaggttgcagtgagccntgcactccagcctgggngacaagagcaaaactcn

SEQ ID NO: 747348 - DNA, 1097 bp, Unknown
  The pattern is a combinatorial arrangement of pyknons in 3'UTRs.
  misc_feature: n indicates the number of nucleotides separating the pyknons that surround it, as specified by Figure 11B.
  misc_feature (1)..(1): n is a, c, g, or t
  misc_feature (18)..(18): n is a, c, g, or t
  misc_feature (35)..(35): n is a, c, g, or t
  misc_feature (52)..(52): n is a, c, g, or t
  misc_feature (76)..(76): n is a, c, g, or t
  misc_feature (95)..(95): n is a, c, g, or t
  misc_feature (112)..(112): n is a, c, g, or t
  misc_feature (129)..(129): n is a, c, g, or t
  misc_feature (147)..(147): n is a, c, g, or t
  misc_feature (165)..(165): n is a, c, g, or t
  misc_feature (182)..(182): n is a, c, g, or t
  misc_feature (199)..(199): n is a, c, g, or t
  misc_feature (216)..(216): n is a, c, g, or t
  misc_feature (235)..(235): n is a, c, g, or t
  misc_feature (268)..(268): n is a, c, g, or t
  misc_feature (285)..(285): n is a, c, g, or t
  misc_feature (320)..(320): n is a, c, g, or t
  misc_feature (337)..(337): n is a, c, g, or t
  misc_feature (355)..(355): n is a, c, g, or t
  misc_feature (372)..(372): n is a, c, g, or t
  misc_feature (405)..(405): n is a, c, g, or t
  misc_feature (438)..(438): n is a, c, g, or t
  misc_feature (456)..(456): n is a, c, g, or t
  misc_feature (474)..(474): n is a, c, g, or t
  misc_feature (507)..(507): n is a, c, g, or t
  misc_feature (524)..(524): n is a, c, g, or t
  misc_feature (561)..(561): n is a, c, g, or t
  misc_feature (578)..(578): n is a, c, g, or t
  misc_feature (595)..(595): n is a, c, g, or t
  misc_feature (612)..(612): n is a, c, g, or t
  misc_feature (629)..(629): n is a, c, g, or t
  misc_feature (646)..(646): n is a, c, g, or t
  misc_feature (664)..(664): n is a, c, g, or t
  misc_feature (681)..(681): n is a, c, g, or t
  misc_feature (698)..(698): n is a, c, g, or t
  misc_feature (715)..(715): n is a, c, g, or t
  misc_feature (732)..(732): n is a, c, g, or t
  misc_feature (749)..(749): n is a, c, g, or t
  misc_feature (769)..(769): n is a, c, g, or t
  misc_feature (786)..(786): n is a, c, g, or t
  misc_feature (803)..(803): n is a, c, g, or t
  misc_feature (820)..(820): n is a, c, g, or t
  misc_feature (837)..(837): n is a, c, g, or t
  misc_feature (854)..(854): n is a, c, g, or t
  misc_feature (871)..(871): n is a, c, g, or t
  misc_feature (888)..(888): n is a, c, g, or t
  misc_feature (905)..(905): n is a, c, g, or t
  misc_feature (922)..(922): n is a, c, g, or t
  misc_feature (942)..(942): n is a, c, g, or t
  misc_feature (960)..(960): n is a, c, g, or t
  misc_feature (979)..(979): n is a, c, g, or t
  misc_feature (996)..(996): n is a, c, g, or t
  misc_feature (1013)..(1013): n is a, c, g, or t
  misc_feature (1030)..(1030): n is a, c, g, or t
  misc_feature (1063)..(1063): n is a, c, g, or t
  misc_feature (1080)..(1080): n is a, c, g, or t
  misc_feature (1097)..(1097): n is a, c, g, or t
ntgtcacccagctggagntggttggagcaggaggncagtggctcacgcctangaagccgaggcgggtggatcaccnagaccatcctggctaacancctatctctacaaaaanttagctgggtgtggtgnctgtagtcccagctactnggctgaggcaggagaatnaacctctgcctccgggncctgcctcagcgtcccnagtagcagggactacancgtgcaccaccatgcccgngtatttttagtagagattggccaggctggtctnaactcttgacctcaagngccaaagtgctgggattataggcgtgagccaccgnctgccaggactgggttntggggacttggggggaancctctctgggctgcagnagtttcactcttgttgcccaggctggagtgcangctcacctcaacctccgcctcccaggttcaagnattctcctgcctcagccnagtagctgggattacagnatgcctggctaattttgtatttttagtagaganagctggtctcgaactcnatctgcccacttcggcctcccaaagtgctgggattanaggcatgagccaccgcngagacagagtctcactncccaggttggagtgcanatctgagctcactgcangcctcttgggttcaagnattctcctgcctcagccnagtagctaggactacancaccatgcccagctaangtatttttagtagaganttggccaggctggtctnacctaaggtgatccacntcccaaagtgctgggattantgagccatggcacctgnggaaaggggtcagggcnggaaactgaggcccagnctctgcctctgggattngtgggcagcccaggagncatctgtgaaatgggantgcctgggtttgaatcntctgtgccttcatttcngctgggattccaggcantaatcccagcactttgggangatcacgaggtcaggagnagaccatcctagctaacanagtgaaaccctatctcnttagctgggcatggtgntgtagtcccagatactntaaggcagaagaatcgcttcaacctgggaggcngaggttgcagtgagccntgcactccagcctgggn

SEQ ID NO: 747349 - DNA, 425 bp, Unknown
  The pattern is a combinatorial arrangement of pyknons in 3'UTRs.
  misc_feature: n indicates the number of nucleotides separating the pyknons that surround it, as specified by Figure 11B.
  misc_feature (1)..(1): n is a, c, g, or t
  misc_feature (37)..(37): n is a, c, g, or t
  misc_feature (55)..(55): n is a, c, g, or t
  misc_feature (74)..(74): n is a, c, g, or t
  misc_feature (91)..(91): n is a, c, g, or t
  misc_feature (109)..(109): n is a, c, g, or t
  misc_feature (144)..(144): n is a, c, g, or t
  misc_feature (161)..(161): n is a, c, g, or t
  misc_feature (178)..(178): n is a, c, g, or t
  misc_feature (195)..(195): n is a, c, g, or t
  misc_feature (212)..(212): n is a, c, g, or t
  misc_feature (231)..(231): n is a, c, g, or t
  misc_feature (252)..(252): n is a, c, g, or t
  misc_feature (269)..(269): n is a, c, g, or t
  misc_feature (287)..(287): n is a, c, g, or t
  misc_feature (306)..(306): n is a, c, g, or t
  misc_feature (323)..(323): n is a, c, g, or t
  misc_feature (341)..(341): n is a, c, g, or t
  misc_feature (374)..(374): n is a, c, g, or t
  misc_feature (391)..(391): n is a, c, g, or t
  misc_feature (408)..(408): n is a, c, g, or t
  misc_feature (425)..(425): n is a, c, g, or t
ncggtggctcacacctgtaatcccagcactttgggangatcacaaggtcaggagnagaccatcctgtctaacanaaattagtcggacatgnctgtagtcccagctactnggctgaggcaggagaatggcgtgaacccaggaggngagcttgcagtgagccntgcactccagcctgggngacagagtgagactccncagtggctcacgcctgncacattgggaggctgaggnatcacctgaggtcaggagttnagaccagcctggccaanctgtaatcccagctactngaggctgaggccggagaancttgagcccgagaggtnaagccaagatcatgccantgcactccagcctgggcaacacagggagactcntttgagaggcctaggcntttttcttgtagaggtncaaaaatgggcaaaatn

SEQ ID NO: 747350 - DNA, 721 bp, Unknown
  The pattern is a combinatorial arrangement of pyknons in 3'UTRs.
  misc_feature: n indicates the number of nucleotides separating the pyknons that surround it, as specified by Figure 11B.
  misc_feature (1)..(1): n is a, c, g, or t
  misc_feature (18)..(18): n is a, c, g, or t
  misc_feature (35)..(35): n is a, c, g, or t
  misc_feature (52)..(52): n is a, c, g, or t
  misc_feature (69)..(69): n is a, c, g, or t
  misc_feature (86)..(86): n is a, c, g, or t
  misc_feature (123)..(123): n is a, c, g, or t
  misc_feature (141)..(141): n is a, c, g, or t
  misc_feature (158)..(158): n is a, c, g, or t
  misc_feature (175)..(175): n is a, c, g, or t
  misc_feature (192)..(192): n is a, c, g, or t
  misc_feature (209)..(209): n is a, c, g, or t
  misc_feature (226)..(226): n is a, c, g, or t
  misc_feature (246)..(246): n is a, c, g, or t
  misc_feature (283)..(283): n is a, c, g, or t
  misc_feature (300)..(300): n is a, c, g, or t
  misc_feature (318)..(318): n is a, c, g, or t
  misc_feature (335)..(335): n is a, c, g, or t
  misc_feature (352)..(352): n is a, c, g, or t
  misc_feature (369)..(369): n is a, c, g, or t
  misc_feature (386)..(386): n is a, c, g, or t
  misc_feature (403)..(403): n is a, c, g, or t
  misc_feature (420)..(420): n is a, c, g, or t
  misc_feature (437)..(437): n is a, c, g, or t
  misc_feature (454)..(454): n is a, c, g, or t
  misc_feature (471)..(471): n is a, c, g, or t
  misc_feature (488)..(488): n is a, c, g, or t
  misc_feature (505)..(505): n is a, c, g, or t
  misc_feature (525)..(525): n is a, c, g, or t
  misc_feature (542)..(542): n is a, c, g, or t
  misc_feature (563)..(563): n is a, c, g, or t
  misc_feature (580)..(580): n is a, c, g, or t
  misc_feature (600)..(600): n is a, c, g, or t
  misc_feature (618)..(618): n is a, c, g, or t
  misc_feature (636)..(636): n is a, c, g, or t
  misc_feature (654)..(654): n is a, c, g, or t
  misc_feature (671)..(671): n is a, c, g, or t
  misc_feature (688)..(688): n is a, c, g, or t
  misc_feature (721)..(721): n is a, c, g, or t
ntttttgtttttgaggcntcgcccagggtggagtnggctcattgcaacctcngcctcccggcttcaagnctgctgcctcagcctcngagtagctgggataacaggtgtggtggcgcatgcctncagctattctggaggctncttgaacccaggaggtngaggttgcagtgagccncaacaagagcaaaactnaagagatgacatttgantgcaaaggccctgaggntaatcccagcactttggganatcacctgaggtcaggagttagaccagcctggccaanttagctgggtgtggtgnctgtaatcccagatactngctgaggcatgagaatncttgaacctgggaggcntgcagtgagctgagatntgcactccagcctgggntagctgggcctggtggntatagtcccagctactngaggctaaggcaggagnctgtgagctatgattgntatactccagcctggcngcaagaccctgtctttnaaaaaaaaatctaggcnggcacggtggctcacgcctntaatctcaacactttgnatcacctgaggtcaggagttnagaccagactgaccaantctctactaaaaacgcaaanttagccgggcgtggtggnctgtaatcccagctactnggctgaggcaggagaatncttgaacccaggaggcntgcagtgagctgagatntgcactccagcctaggcaacaagagtgaaactn

SEQ ID NO: 747351 - DNA, 830 bp, Unknown
  The pattern is a combinatorial arrangement of pyknons in 3'UTRs.
  misc_feature: n indicates the number of nucleotides separating the pyknons that surround it, as specified by Figure 11B.
  misc_feature (1)..(1): n is a, c, g, or t
  misc_feature (18)..(18): n is a, c, g, or t
  misc_feature (35)..(35): n is a, c, g, or t
  misc_feature (71)..(71): n is a, c, g, or t
  misc_feature (88)..(88): n is a, c, g, or t
  misc_feature (105)..(105): n is a, c, g, or t
  misc_feature (122)..(122): n is a, c, g, or t
  misc_feature (155)..(155): n is a, c, g, or t
  misc_feature (172)..(172): n is a, c, g, or t
  misc_feature (189)..(189): n is a, c, g, or t
  misc_feature (206)..(206): n is a, c, g, or t
  misc_feature (223)..(223): n is a, c, g, or t
  misc_feature (240)..(240): n is a, c, g, or t
  misc_feature (257)..(257): n is a, c, g, or t
  misc_feature (274)..(274): n is a, c, g, or t
  misc_feature (291)..(291): n is a, c, g, or t
  misc_feature (308)..(308): n is a, c, g, or t
  misc_feature (325)..(325): n is a, c, g, or t
  misc_feature (342)..(342): n is a, c, g, or t
  misc_feature (359)..(359): n is a, c, g, or t
  misc_feature (376)..(376): n is a, c, g, or t
  misc_feature (394)..(394): n is a, c, g, or t
  misc_feature (427)..(427): n is a, c, g, or t
  misc_feature (444)..(444): n is a, c, g, or t
  misc_feature (463)..(463): n is a, c, g, or t
  misc_feature (480)..(480): n is a, c, g, or t
  misc_feature (514)..(514): n is a, c, g, or t
  misc_feature (531)..(531): n is a, c, g, or t
  misc_feature (548)..(548): n is a, c, g, or t
  misc_feature (565)..(565): n is a, c, g, or t
  misc_feature (582)..(582): n is a, c, g, or t
  misc_feature (599)..(599): n is a, c, g, or t
  misc_feature (616)..(616): n is a, c, g, or t
  misc_feature (633)..(633): n is a, c, g, or t
  misc_feature (650)..(650): n is a, c, g, or t
  misc_feature (670)..(670): n is a, c, g, or t
  misc_feature (688)..(688): n is a, c, g, or t
  misc_feature (707)..(707): n is a, c, g, or t
  misc_feature (724)..(724): n is a, c, g, or t
  misc_feature (742)..(742): n is a, c, g, or t
  misc_feature (779)..(779): n is a, c, g, or t
  misc_feature (796)..(796): n is a, c, g, or t
  misc_feature (813)..(813): n is a, c, g, or t
  misc_feature (830)..(830): n is a, c, g, or t
ntcctctgtctctgcctnttgaattttgtaaaatncagtggctcacacctgtaatcccagccctttggganctgaggcaggtggattncttgagcccaggagttnctcatctctacaaaaangtggtggcgtgtacctctagtcccagctacccnctaggctgcagtgagcntgcactccagcctggtnacagtgaggccctgtcnaaaaaaaatttttctgnactgagcacttaaaatnaaaatgttactgaaatnatcatgttatttttctnttggaaattattttaanttttgttgaaagcaaanatattcactttttaaanatacatatttacataanatagaaacttttaaaangggcatggtggctcacntaatcccagcactttgtngaggtgggcggatctcctaaggtcaggagttcnagaccagcctggccaanatggtgaaaccccgtcttnttagccaggcgtggtgnctgtaatcctagctactcaggaggcaggaaaatncttgaacctgggaggcngaggttgcagtgagccntgcactccagcctgggngacagagtgagactccntgagaatattttaaatnattttattttcaagatntcattccaattttagtncaaaggccgggcgcggntaatcccagcactttgggangatcacgaggtcaggagnagaccatcctggctaacanattagccaggcctggtnctgtagtcccagctactngaggctgaggcaggagaacggcgtgaacccgggaggngagcttgcagtgagccntgcactccagcctaggnggcagagccagactccn

SEQ ID NO: 747352 - DNA, 19 bp, Unknown
  The pattern is an example of a pyknon.
tcccaaagtgctgggatta

SEQ ID NO: 747353 - DNA, 16 bp, Unknown
  The pattern is an example of a pyknon.
cccaggctggagtgca

SEQ ID NO: 747354 - DNA, 17 bp, Unknown
  The pattern is an example of a pyknon.
agtagctgggattacag

SEQ ID NO: 747355 - DNA, 20 bp, Unknown
  The pattern is an example of a pyknon.
aactcctgacctcaggtgat

SEQ ID NO: 747356 - DNA, 1222 bp, Homo sapiens
  misc_feature: n indicates a number of nucleotides that separate the surrounding pyknons, as specificed in Figure 12.
  misc_feature (1)..(1): n is a, c, g, or t
  misc_feature (18)..(18): n is a, c, g, or t
  misc_feature (35)..(35): n is a, c, g, or t
  misc_feature (52)..(52): n is a, c, g, or t
  misc_feature (69)..(69): n is a, c, g, or t
  misc_feature (86)..(86): n is a, c, g, or t
  misc_feature (106)..(106): n is a, c, g, or t
  misc_feature (124)..(124): n is a, c, g, or t
  misc_feature (142)..(142): n is a, c, g, or t
  misc_feature (160)..(160): n is a, c, g, or t
  misc_feature (178)..(178): n is a, c, g, or t
  misc_feature (199)..(199): n is a, c, g, or t
  misc_feature (219)..(219): n is a, c, g, or t
  misc_feature (236)..(236): n is a, c, g, or t
  misc_feature (253)..(253): n is a, c, g, or t
  misc_feature (270)..(270): n is a, c, g, or t
  misc_feature (287)..(287): n is a, c, g, or t
  misc_feature (305)..(305): n is a, c, g, or t
  misc_feature (346)..(346): n is a, c, g, or t
  misc_feature (363)..(363): n is a, c, g, or t
  misc_feature (380)..(380): n is a, c, g, or t
  misc_feature (397)..(397): n is a, c, g, or t
  misc_feature (414)..(414): n is a, c, g, or t
  misc_feature (431)..(431): n is a, c, g, or t
  misc_feature (466)..(466): n is a, c, g, or t
  misc_feature (483)..(483): n is a, c, g, or t
  misc_feature (500)..(500): n is a, c, g, or t
  misc_feature (517)..(517): n is a, c, g, or t
  misc_feature (536)..(536): n is a, c, g, or t
  misc_feature (553)..(553): n is a, c, g, or t
  misc_feature (570)..(570): n is a, c, g, or t
  misc_feature (587)..(587): n is a, c, g, or t
  misc_feature (608)..(608): n is a, c, g, or t
  misc_feature (628)..(628): n is a, c, g, or t
  misc_feature (645)..(645): n is a, c, g, or t
  misc_feature (662)..(662): n is a, c, g, or t
  misc_feature (679)..(679): n is a, c, g, or t
  misc_feature (699)..(699): n is a, c, g, or t
  misc_feature (718)..(718): n is a, c, g, or t
  misc_feature (738)..(738): n is a, c, g, or t
  misc_feature (756)..(756): n is a, c, g, or t
  misc_feature (773)..(773): n is a, c, g, or t
  misc_feature (792)..(792): n is a, c, g, or t
  misc_feature (810)..(810): n is a, c, g, or t
  misc_feature (827)..(827): n is a, c, g, or t
  misc_feature (844)..(844): n is a, c, g, or t
  misc_feature (863)..(863): n is a, c, g, or t
  misc_feature (880)..(880): n is a, c, g, or t
  misc_feature (897)..(897): n is a, c, g, or t
  misc_feature (914)..(914): n is a, c, g, or t
  misc_feature (932)..(932): n is a, c, g, or t
  misc_feature (985)..(985): n is a, c, g, or t
  misc_feature (1005)..(1005): n is a, c, g, or t
  misc_feature (1022)..(1022): n is a, c, g, or t
  misc_feature (1039)..(1039): n is a, c, g, or t
  misc_feature (1060)..(1060): n is a, c, g, or t
  misc_feature (1081)..(1081): n is a, c, g, or t
  misc_feature (1098)..(1098): n is a, c, g, or t
  misc_feature (1133)..(1133): n is a, c, g, or t
  misc_feature (1150)..(1150): n is a, c, g, or t
  misc_feature (1170)..(1170): n is a, c, g, or t
  misc_feature (1187)..(1187): n is a, c, g, or t
  misc_feature (1204)..(1204): n is a, c, g, or t
  misc_feature (1222)..(1222): n is a, c, g, or t
ntttcttcattcattcangacagtctcgctctgtncccaggctggagtgcanatctcagctcactgcangccttccaggttcaagnagtctcctgcctcagcctcnagtagctgggattacagnaccacgcctggctaattncatttttagtagagacgncttcaccatgttggccanaactcctgacctcaggtaatntcccaaagtgctgagattangtgagctaccgtgcccnggtggtcagggaaggcnaggcaggaggaacagcnttcattcaacaaatatnttgcccaggctggagttnagctcactgcaacctccacctcccagattcaagtgattctnaatagctgggactacanatgtcaccatgcccagnttggccaggctggtctnaactcctggcctcaaanaatctacctgccttggntccaaagtgctaggattacaggtgtgagccaccgncccaggctggagtgcanggctcattgcaacctcnacctcccgggttcaagntcagcttcctgagtagctntacaggcacttgccacngacagggttttgccatnttggccaggctggtctnaactcctgacctcaggtgatntcccaaagtgctggcattanggcttgagccaccacgnggagtctcgctctgtcngctggagtgcagtgacntgatctcggctcactgcagnctccgccttctgggttcanattctcctgcctcagcctcnagtagctgggactacagnccacctcgcctggctantgttagccaggatggtctnctcgtgacctcgtgatcnccagcctcggcctcccntgagatggagtttcgcntcaggctggagtgcaatgnatctcagctcactgcangcctcccaggttcaagnattctcccacctcagcnagtagctgggattacagnggggtttcactatgttggccaagctggtcttgaactcctgacctcaggtgatntcccaaagtgctgggattantggaggtagggcctggntgaatgaaagaatgaantttgggaggccaaggtgggtnatcacctgaggtcaggagttnagaccagcctggccaancctctactaaaaatacaaaaaattagctgggcgtntgcctgtaatcacagcngaggctgaggcaggagaatngaggttgcagtgagccntgccattgcactccagnggcaacagagcgagactn

SEQ ID NO: 747357 - DNA, 451 bp, Unknown
  The pattern is a 5'UTR mosaic composed of pyknons.
  misc_feature: n indicates a number of nucleotides that separate the surrounding pyknons, as specificed in Figure 12.
  misc_feature (1)..(1): n is a, c, g, or t
  misc_feature (18)..(18): n is a, c, g, or t
  misc_feature (52)..(52): n is a, c, g, or t
  misc_feature (69)..(69): n is a, c, g, or t
  misc_feature (86)..(86): n is a, c, g, or t
  misc_feature (103)..(103): n is a, c, g, or t
  misc_feature (120)..(120): n is a, c, g, or t
  misc_feature (137)..(137): n is a, c, g, or t
  misc_feature (154)..(154): n is a, c, g, or t
  misc_feature (174)..(174): n is a, c, g, or t
  misc_feature (191)..(191): n is a, c, g, or t
  misc_feature (208)..(208): n is a, c, g, or t
  misc_feature (225)..(225): n is a, c, g, or t
  misc_feature (242)..(242): n is a, c, g, or t
  misc_feature (259)..(259): n is a, c, g, or t
  misc_feature (292)..(292): n is a, c, g, or t
  misc_feature (309)..(309): n is a, c, g, or t
  misc_feature (327)..(327): n is a, c, g, or t
  misc_feature (344)..(344): n is a, c, g, or t
  misc_feature (361)..(361): n is a, c, g, or t
  misc_feature (382)..(382): n is a, c, g, or t
  misc_feature (399)..(399): n is a, c, g, or t
  misc_feature (416)..(416): n is a, c, g, or t
  misc_feature (433)..(433): n is a, c, g, or t
  misc_feature (451)..(451): n is a, c, g, or t
ngagtcttgctctgttgngaggctggagtgcagtgatctcagctcactggangcctcctgggttcaagntctcaacctcccaagtntgccaccacacctgccntttttagtagggatggnttgggcaggctggtctnaactcctgacctcaagntcccagagtgctgggattantgagccaccatgcctgncctgtctctaaaacaancagaaattttctttttngagacagagtcttactntcgctcaggctggagtnatctcagctcactgcaacctctgcctcctggtnctccttcctcagcctcnagtagctgggattacacnccaccgcgcctggctanttggccaggctggtctnaactcctgacctcaggtgatnagcctcccaaaatgctncaggcatgagccaccgnctcagtttcttcatttnggggttgctgccagctgn

SEQ ID NO: 747358 - DNA, 402 bp, Unknown
  The pattern is a 5'UTR mosaic composed of pyknons.
  misc_feature: n indicates a number of nucleotides that separate the surrounding pyknons, as specificed in Figure 12.
  misc_feature (1)..(1): n is a, c, g, or t
  misc_feature (20)..(20): n is a, c, g, or t
  misc_feature (37)..(37): n is a, c, g, or t
  misc_feature (54)..(54): n is a, c, g, or t
  misc_feature (72)..(72): n is a, c, g, or t
  misc_feature (89)..(89): n is a, c, g, or t
  misc_feature (125)..(125): n is a, c, g, or t
  misc_feature (142)..(142): n is a, c, g, or t
  misc_feature (159)..(159): n is a, c, g, or t
  misc_feature (176)..(176): n is a, c, g, or t
  misc_feature (193)..(193): n is a, c, g, or t
  misc_feature (210)..(210): n is a, c, g, or t
  misc_feature (230)..(230): n is a, c, g, or t
  misc_feature (248)..(248): n is a, c, g, or t
  misc_feature (281)..(281): n is a, c, g, or t
  misc_feature (298)..(298): n is a, c, g, or t
  misc_feature (315)..(315): n is a, c, g, or t
  misc_feature (332)..(332): n is a, c, g, or t
  misc_feature (368)..(368): n is a, c, g, or t
  misc_feature (385)..(385): n is a, c, g, or t
  misc_feature (402)..(402): n is a, c, g, or t
ntgctgggattacaggcgcnaccacgcccggctaatngggtttcactgtgttgnaggatggtctctatctcngtgatatgcccgcctcntcccaaagtgctgggattacaggcttgagccaccgnggcctatttatttattngagacggagtgttgctncccaggctggagtgcanggctcactgcaacctcngcctcccgggttcaagnattctcctgcctcagcctcnagtagctgggattacagnacacccggctaattttgtatttttagtagaaangggtttctccatgttgnctggtttcgaactcccngtcatctgcctgcctcntcccaaagtgctgggattacaggcgtgagccaccgntctgtatttttaaaaantaaatgatttgcccaan

SEQ ID NO: 747359 - DNA, 550 bp, Unknown
  The pattern is a 5'UTR mosaic composed of pyknons.
  misc_feature: n indicates a number of nucleotides that separate the surrounding pyknons, as specificed in Figure 12.
  misc_feature (1)..(1): n is a, c, g, or t
  misc_feature (18)..(18): n is a, c, g, or t
  misc_feature (35)..(35): n is a, c, g, or t
  misc_feature (52)..(52): n is a, c, g, or t
  misc_feature (69)..(69): n is a, c, g, or t
  misc_feature (86)..(86): n is a, c, g, or t
  misc_feature (103)..(103): n is a, c, g, or t
  misc_feature (120)..(120): n is a, c, g, or t
  misc_feature (140)..(140): n is a, c, g, or t
  misc_feature (158)..(158): n is a, c, g, or t
  misc_feature (175)..(175): n is a, c, g, or t
  misc_feature (192)..(192): n is a, c, g, or t
  misc_feature (213)..(213): n is a, c, g, or t
  misc_feature (233)..(233): n is a, c, g, or t
  misc_feature (250)..(250): n is a, c, g, or t
  misc_feature (267)..(267): n is a, c, g, or t
  misc_feature (284)..(284): n is a, c, g, or t
  misc_feature (301)..(301): n is a, c, g, or t
  misc_feature (318)..(318): n is a, c, g, or t
  misc_feature (335)..(335): n is a, c, g, or t
  misc_feature (352)..(352): n is a, c, g, or t
  misc_feature (370)..(370): n is a, c, g, or t
  misc_feature (387)..(387): n is a, c, g, or t
  misc_feature (404)..(404): n is a, c, g, or t
  misc_feature (421)..(421): n is a, c, g, or t
  misc_feature (439)..(439): n is a, c, g, or t
  misc_feature (460)..(460): n is a, c, g, or t
  misc_feature (478)..(478): n is a, c, g, or t
  misc_feature (495)..(495): n is a, c, g, or t
  misc_feature (512)..(512): n is a, c, g, or t
  misc_feature (534)..(534): n is a, c, g, or t
nacaacacccaagtcctngcctgagtgcagtggcnttcttcaaagaagaaantttgagacagagtctcncccaggctggagtgcanggctcactacaacctcngcctcccaggttcaaanattctcctgcctcagcctcnagtagctgggattacagnatagagatggggtttcnttggccaggctggtctnaactcctgacctcaggtgatntcccaaagtgctgggattancaccacacccagccatnattatgttttctaaaancagactctgcctcaaangagtcttgctctgttgncgctggagtgcagtggnggctcactgcaacctcngctcccaggttcaagcnagtagctgggactacagnacatccggctaattttnatagagacggggttttnttggccaggatggtctnctcctgacctcatgatcnagcctcccaaagtgctggggnaggcatgagccaccacgngtcttgctctgtcaccntgcagccttgaactccncctcctgcctcagcctcccganacaggtatgtaccacc

SEQ ID NO: 747360 - DNA, 475 bp, Unknown
  The pattern is a 5'UTR mosaic composed of pyknons.
  misc_feature: n indicates a number of nucleotides that separate the surrounding pyknons, as specificed in Figure 12.
  misc_feature (1)..(1): n is a, c, g, or t
  misc_feature (35)..(35): n is a, c, g, or t
  misc_feature (52)..(52): n is a, c, g, or t
  misc_feature (69)..(69): n is a, c, g, or t
  misc_feature (89)..(89): n is a, c, g, or t
  misc_feature (109)..(109): n is a, c, g, or t
  misc_feature (127)..(127): n is a, c, g, or t
  misc_feature (144)..(144): n is a, c, g, or t
  misc_feature (161)..(161): n is a, c, g, or t
  misc_feature (182)..(182): n is a, c, g, or t
  misc_feature (218)..(218): n is a, c, g, or t
  misc_feature (251)..(251): n is a, c, g, or t
  misc_feature (268)..(268): n is a, c, g, or t
  misc_feature (286)..(286): n is a, c, g, or t
  misc_feature (303)..(303): n is a, c, g, or t
  misc_feature (320)..(320): n is a, c, g, or t
  misc_feature (353)..(353): n is a, c, g, or t
  misc_feature (371)..(371): n is a, c, g, or t
  misc_feature (390)..(390): n is a, c, g, or t
  misc_feature (407)..(407): n is a, c, g, or t
  misc_feature (424)..(424): n is a, c, g, or t
  misc_feature (441)..(441): n is a, c, g, or t
  misc_feature (458)..(458): n is a, c, g, or t
  misc_feature (475)..(475): n is a, c, g, or t
nagagtcttgctctgtcgcccaggctggagtgcanggctcactgcaacctcngcctcccaggttcaagnattctcctgcctcagcctcntgtagctgggattacaggcncaccatgcccggctaatnttatttttagtagaganttggccaggctggtctnaactcctgacctcaggtgatntcccaaagtgctgggattacaggcgtgagccaccgntggtcttgctgtgtcacccaggctggagtgcantcttgaattcctgggcnaagcctcccaagtagctncaggcacatactaccantttttgtagagacaggnttactatgttgcccagactggtcttgaactccnattacaggtgtgagcctngtttttttgagacagggtncccaggctggagtgcanggctcactgcagcctcncctcccaaggctcaggnatcctcttgcctcagcnaccaagtagctgggacn

SEQ ID NO: 747361 - DNA, 199 bp, Unknown
  The pattern is a 5'UTR mosaic composed of pyknons.
  misc_feature: n indicates a number of nucleotides that separate the surrounding pyknons, as specificed in Figure 12.
  misc_feature (1)..(1): n is a, c, g, or t
  misc_feature (18)..(18): n is a, c, g, or t
  misc_feature (35)..(35): n is a, c, g, or t
  misc_feature (53)..(53): n is a, c, g, or t
  misc_feature (73)..(73): n is a, c, g, or t
  misc_feature (91)..(91): n is a, c, g, or t
  misc_feature (108)..(108): n is a, c, g, or t
  misc_feature (125)..(125): n is a, c, g, or t
  misc_feature (146)..(146): n is a, c, g, or t
  misc_feature (182)..(182): n is a, c, g, or t
  misc_feature (199)..(199): n is a, c, g, or t
nggctggagggcagaggncccaggctggagtgcangatctcggctcactgcgnattctcctgcctcagcctcnagtagctgggattacagnccatcacgcccggctanttggtcaggctagtctnaactcctgacctcaggtgatntcccaaagtgctgggattacaggcgtgagccaccgngcagagactggagggan

SEQ ID NO: 747362 - DNA, 506 bp, Unknown
  The pattern is a 5'UTR mosaic composed of pyknons.
  misc_feature: n indicates a number of nucleotides that separate the surrounding pyknons, as specificed in Figure 12.
  misc_feature (1)..(1): n is a, c, g, or t
  misc_feature (53)..(53): n is a, c, g, or t
  misc_feature (105)..(105): n is a, c, g, or t
  misc_feature (122)..(122): n is a, c, g, or t
  misc_feature (143)..(143): n is a, c, g, or t
  misc_feature (160)..(160): n is a, c, g, or t
  misc_feature (177)..(177): n is a, c, g, or t
  misc_feature (213)..(213): n is a, c, g, or t
  misc_feature (230)..(230): n is a, c, g, or t
  misc_feature (247)..(247): n is a, c, g, or t
  misc_feature (280)..(280): n is a, c, g, or t
  misc_feature (297)..(297): n is a, c, g, or t
  misc_feature (314)..(314): n is a, c, g, or t
  misc_feature (331)..(331): n is a, c, g, or t
  misc_feature (349)..(349): n is a, c, g, or t
  misc_feature (366)..(366): n is a, c, g, or t
  misc_feature (383)..(383): n is a, c, g, or t
  misc_feature (400)..(400): n is a, c, g, or t
  misc_feature (419)..(419): n is a, c, g, or t
  misc_feature (455)..(455): n is a, c, g, or t
  misc_feature (472)..(472): n is a, c, g, or t
  misc_feature (489)..(489): n is a, c, g, or t
  misc_feature (506)..(506): n is a, c, g, or t
ntctgttgccaggctggagtgccgtggtgtgatctcggctcactgcaacctcnctctcaggttcaagcgattctcctgcctcagcctcctcagtagctgggattnaggcatgcactaccatntagagatggggtttcaccacnttgcccaggctggtctnaactcctgacctcaacntcccaaagtgctgggattacaggcgtgagccaccgncccggcctgattttttnctggataaagagaatgngagtcttgctctgttgctcaggctggagtgcangatctcagctcattgcngccccccaggttcaagnttcctgcctcagcctcnagtagctgggattacagnacacctggctaattttnattttagtagagatggnttggccaggatggtctncctcaagtgatctgcctgntcccaaagtgctaggattacaggtgtgagccatcantttccttatctgtaaangaatgactttggggtanttctttcttttccatgn

SEQ ID NO: 747363 - DNA, 542 bp, Unknown
  The pattern is a 5'UTR mosaic composed of pyknons.
  misc_feature: n indicates a number of nucleotides that separate the surrounding pyknons, as specificed in Figure 12.
  misc_feature (1)..(1): n is a, c, g, or t
  misc_feature (18)..(18): n is a, c, g, or t
  misc_feature (51)..(51): n is a, c, g, or t
  misc_feature (68)..(68): n is a, c, g, or t
  misc_feature (85)..(85): n is a, c, g, or t
  misc_feature (103)..(103): n is a, c, g, or t
  misc_feature (121)..(121): n is a, c, g, or t
  misc_feature (138)..(138): n is a, c, g, or t
  misc_feature (159)..(159): n is a, c, g, or t
  misc_feature (176)..(176): n is a, c, g, or t
  misc_feature (194)..(194): n is a, c, g, or t
  misc_feature (230)..(230): n is a, c, g, or t
  misc_feature (247)..(247): n is a, c, g, or t
  misc_feature (264)..(264): n is a, c, g, or t
  misc_feature (281)..(281): n is a, c, g, or t
  misc_feature (300)..(300): n is a, c, g, or t
  misc_feature (317)..(317): n is a, c, g, or t
  misc_feature (350)..(350): n is a, c, g, or t
  misc_feature (368)..(368): n is a, c, g, or t
  misc_feature (387)..(387): n is a, c, g, or t
  misc_feature (405)..(405): n is a, c, g, or t
  misc_feature (441)..(441): n is a, c, g, or t
  misc_feature (458)..(458): n is a, c, g, or t
  misc_feature (491)..(491): n is a, c, g, or t
  misc_feature (508)..(508): n is a, c, g, or t
  misc_feature (525)..(525): n is a, c, g, or t
  misc_feature (542)..(542): n is a, c, g, or t
nacatattttaaattctngagtcttgctctgttgcccaggctggagtgcangtctcagctcactgcangcctcttgggttcaagntcctacctcagcctcctnagtagctgggattacagntaccaccatgtccagcnttttactagagatggggtttnttggccaggctggtctnctcctgacctcatgatcntcccaaagtgctgggattacaggcatgagccaccgngaatgggcaaaagctgngtcttgctctgtcaccnaggctagagtgcagtgnttcagctcactgcaacctngcctcccgggttcaagngcctccacctcctgagcagctgggattacaggncaccatgcccggctaatntgttagccaggattgtctnctcttgacctcgtgatcntcccaaagtgctgggattacaggcgtgagccactgncaatgttttacagtttnctcaaggttacacagcgagtgtgtgtgagaganaacccaggaggttgaanatctgacctttctctcntgtgccaggcccagggn

SEQ ID NO: 747364 - DNA, 467 bp, Unknown
  The pattern is a 5'UTR mosaic composed of pyknons.
  misc_feature: n indicates a number of nucleotides that separate the surrounding pyknons, as specificed in Figure 12.
  misc_feature (1)..(1): n is a, c, g, or t
  misc_feature (18)..(18): n is a, c, g, or t
  misc_feature (35)..(35): n is a, c, g, or t
  misc_feature (52)..(52): n is a, c, g, or t
  misc_feature (69)..(69): n is a, c, g, or t
  misc_feature (86)..(86): n is a, c, g, or t
  misc_feature (103)..(103): n is a, c, g, or t
  misc_feature (120)..(120): n is a, c, g, or t
  misc_feature (137)..(137): n is a, c, g, or t
  misc_feature (154)..(154): n is a, c, g, or t
  misc_feature (171)..(171): n is a, c, g, or t
  misc_feature (188)..(188): n is a, c, g, or t
  misc_feature (206)..(206): n is a, c, g, or t
  misc_feature (223)..(223): n is a, c, g, or t
  misc_feature (240)..(240): n is a, c, g, or t
  misc_feature (257)..(257): n is a, c, g, or t
  misc_feature (274)..(274): n is a, c, g, or t
  misc_feature (291)..(291): n is a, c, g, or t
  misc_feature (309)..(309): n is a, c, g, or t
  misc_feature (328)..(328): n is a, c, g, or t
  misc_feature (345)..(345): n is a, c, g, or t
  misc_feature (362)..(362): n is a, c, g, or t
  misc_feature (379)..(379): n is a, c, g, or t
  misc_feature (399)..(399): n is a, c, g, or t
  misc_feature (416)..(416): n is a, c, g, or t
  misc_feature (433)..(433): n is a, c, g, or t
  misc_feature (450)..(450): n is a, c, g, or t
  misc_feature (467)..(467): n is a, c, g, or t
nttgtcgcccacgctggnatctcagttcactgcangcctcccaggttcaagntgcctcagcttcccganagctaggactacaggtnacgctcagctaattttngatggggttttcccatnttggccaggctggtctnaactcctgacctcagancaggcgtgagccactgnacattttggtatgtttntgaacaggcaacttacanaataatattttcttcantgctggagtgcaatggnggctcactgcaacctcngcctcctgggttcaggnctcctgcctcagactcnagtagctgggattacagngcctgccaccacgcccggngtgtttcactatgttgngggctggtctcgaactnctgccctcaggtgatcntcccaaagtgctgggattanggcgtgagccactgctntagatgaaacaagattntatgcatgtatctttantttttttttaaagactn

SEQ ID NO: 747365 - DNA, 16 bp, Unknown
  The pattern is an example of a pyknon.
aaatgtgaagaatgtg

SEQ ID NO: 747366 - DNA, 16 bp, Unknown
  The pattern is an example of a pyknon.
tcatactggagagaaa

SEQ ID NO: 747367 - DNA, 16 bp, Unknown
  The pattern is an example of a pyknon.
acaagtgtgaagaatg

SEQ ID NO: 747368 - DNA, 16 bp, Unknown
  The pattern is an example of a pyknon.
catactgaagagaaac

SEQ ID NO: 747369 - DNA, 290 bp, Unknown
  The pattern is an amino acid coding region mosaic composed of pyknons.
  misc_feature: n indicates a number of nucleotides that separate the surrounding pyknons, as specified by Figure 13.
  misc_feature (1)..(1): n is a, c, g, or t
  misc_feature (18)..(18): n is a, c, g, or t
  misc_feature (35)..(35): n is a, c, g, or t
  misc_feature (52)..(52): n is a, c, g, or t
  misc_feature (69)..(69): n is a, c, g, or t
  misc_feature (86)..(86): n is a, c, g, or t
  misc_feature (103)..(103): n is a, c, g, or t
  misc_feature (120)..(120): n is a, c, g, or t
  misc_feature (137)..(137): n is a, c, g, or t
  misc_feature (154)..(154): n is a, c, g, or t
  misc_feature (171)..(171): n is a, c, g, or t
  misc_feature (188)..(188): n is a, c, g, or t
  misc_feature (205)..(205): n is a, c, g, or t
  misc_feature (222)..(222): n is a, c, g, or t
  misc_feature (239)..(239): n is a, c, g, or t
  misc_feature (256)..(256): n is a, c, g, or t
  misc_feature (273)..(273): n is a, c, g, or t
  misc_feature (290)..(290): n is a, c, g, or t
naaggaaaaaaacctttnagcagagcataaaaganatttacagtttaaaaanaaatgtgaagaatgtgntcatactggagagaaanaaatgtgaagaatgtgntcatactggagagaaanaaatgtgaagaatgtgnaaatgtgaagaatgtgntcatactggagagaaanaaatgtgaagaatgtgnaaatgtgaagaatgtgntcatactggagagaaanaaatgtgaagaatgtgntcatactggagagaaanaaatgtgaagaatgtgntcatactggagagaaan

SEQ ID NO: 747370 - DNA, 222 bp, Unknown
  The pattern is an amino acid coding region mosaic composed of pyknons.
  misc_feature: n indicates a number of nucleotides that separate the surrounding pyknons, as specified by Figure 13.
  misc_feature (1)..(1): n is a, c, g, or t
  misc_feature (18)..(18): n is a, c, g, or t
  misc_feature (35)..(35): n is a, c, g, or t
  misc_feature (52)..(52): n is a, c, g, or t
  misc_feature (69)..(69): n is a, c, g, or t
  misc_feature (86)..(86): n is a, c, g, or t
  misc_feature (103)..(103): n is a, c, g, or t
  misc_feature (120)..(120): n is a, c, g, or t
  misc_feature (137)..(137): n is a, c, g, or t
  misc_feature (154)..(154): n is a, c, g, or t
  misc_feature (171)..(171): n is a, c, g, or t
  misc_feature (188)..(188): n is a, c, g, or t
  misc_feature (205)..(205): n is a, c, g, or t
  misc_feature (222)..(222): n is a, c, g, or t
naaatgtgaagaatgtgnaaatgtgaagaatgtgntcatactggagagaaantcatactggagagaaantcatactggagagaaanaaatgtgaagaatgtgntcatactggagagaaantcatactggagagaaanaaatgtgaagaatgtgntcatactggagagaaanaaatgtaaagaatgtgntcatactggagagaaanaaatgtgaagaatgtgn

SEQ ID NO: 747371 - DNA, 188 bp, Unknown
  The pattern is an amino acid coding region mosaic composed of pyknons.
  misc_feature: n indicates a number of nucleotides that separate the surrounding pyknons, as specified by Figure 13.
  misc_feature (1)..(1): n is a, c, g, or t
  misc_feature (18)..(18): n is a, c, g, or t
  misc_feature (35)..(35): n is a, c, g, or t
  misc_feature (52)..(52): n is a, c, g, or t
  misc_feature (69)..(69): n is a, c, g, or t
  misc_feature (86)..(86): n is a, c, g, or t
  misc_feature (103)..(103): n is a, c, g, or t
  misc_feature (120)..(120): n is a, c, g, or t
  misc_feature (137)..(137): n is a, c, g, or t
  misc_feature (154)..(154): n is a, c, g, or t
  misc_feature (171)..(171): n is a, c, g, or t
  misc_feature (188)..(188): n is a, c, g, or t
naaatgtgaagaatgtgntcatactggagagaaanaaatgtgaagaatgtgnaaatgtgaagaatgtgncatactgaagagaaacnaaatgtgaagaatgtgntgtgaaaaatgtggcanaaatgtgaagaatgtgnaaatgtgaagaatgtgnaaatgtgaagaatgtgntcatactggagagaaan

SEQ ID NO: 747372 - DNA, 409 bp, Unknown
  The pattern is an amino acid coding region mosaic composed of pyknons.
  misc_feature: n indicates a number of nucleotides that separate the surrounding pyknons, as specified by Figure 13.
  misc_feature (1)..(1): n is a, c, g, or t
  misc_feature (18)..(18): n is a, c, g, or t
  misc_feature (35)..(35): n is a, c, g, or t
  misc_feature (52)..(52): n is a, c, g, or t
  misc_feature (69)..(69): n is a, c, g, or t
  misc_feature (86)..(86): n is a, c, g, or t
  misc_feature (103)..(103): n is a, c, g, or t
  misc_feature (120)..(120): n is a, c, g, or t
  misc_feature (137)..(137): n is a, c, g, or t
  misc_feature (154)..(154): n is a, c, g, or t
  misc_feature (171)..(171): n is a, c, g, or t
  misc_feature (188)..(188): n is a, c, g, or t
  misc_feature (205)..(205): n is a, c, g, or t
  misc_feature (222)..(222): n is a, c, g, or t
  misc_feature (239)..(239): n is a, c, g, or t
  misc_feature (256)..(256): n is a, c, g, or t
  misc_feature (273)..(273): n is a, c, g, or t
  misc_feature (290)..(290): n is a, c, g, or t
  misc_feature (307)..(307): n is a, c, g, or t
  misc_feature (324)..(324): n is a, c, g, or t
  misc_feature (341)..(341): n is a, c, g, or t
  misc_feature (358)..(358): n is a, c, g, or t
  misc_feature (375)..(375): n is a, c, g, or t
  misc_feature (392)..(392): n is a, c, g, or t
  misc_feature (409)..(409): n is a, c, g, or t
naatttatatagaaatgntcttttcaaaaagcaantttacagttaagaaaantgataaatatttgaaanaaatgtaaagaatgtgnaaatgtgaagaatgtgntcatactggagagaaanacaagtgtgaagaatgnacaagtgtgaagaatgnacactggagagaaaccnaaatgtgaagaatgtgntcatactggagagaaantcatactggagagaaanacaagtgtgaagaatgnaaatgtgaagaatgtgnacactggagagaaaccnaaatgtgaagaatgtgntcatactggagagaaanaaatgtgaagaatgtgncatactgaagagaaacntgtgaaaaatgtggcantcatactggagagaaanaaatgtgaagaatgtgnaaatgtgaagaatgtgn

SEQ ID NO: 747373 - DNA, 239 bp, Unknown
  The pattern is an amino acid coding region mosaic composed of pyknons.
  misc_feature: n indicates a number of nucleotides that separate the surrounding pyknons, as specified by Figure 13.
  misc_feature (1)..(1): n is a, c, g, or t
  misc_feature (18)..(18): n is a, c, g, or t
  misc_feature (35)..(35): n is a, c, g, or t
  misc_feature (52)..(52): n is a, c, g, or t
  misc_feature (69)..(69): n is a, c, g, or t
  misc_feature (86)..(86): n is a, c, g, or t
  misc_feature (103)..(103): n is a, c, g, or t
  misc_feature (120)..(120): n is a, c, g, or t
  misc_feature (137)..(137): n is a, c, g, or t
  misc_feature (154)..(154): n is a, c, g, or t
  misc_feature (171)..(171): n is a, c, g, or t
  misc_feature (188)..(188): n is a, c, g, or t
  misc_feature (205)..(205): n is a, c, g, or t
  misc_feature (222)..(222): n is a, c, g, or t
  misc_feature (239)..(239): n is a, c, g, or t
naaatgtgaagaatgtgntaaacaattctcaaaantcatactggagagaaanaaatgtgaagaatgtgnaaatgtgaagaatgtgncatactgaagagaaacnaaatgtgaagaatgtgntcatactggagagaaantgtgaaaaatgtggcanaaatgtgaagaatgtgncatactgaagagaaacncatactgaagagaaacnaaatgtgaagaatgtgntcatactggagagaaan

SEQ ID NO: 747374 - DNA, 171 bp, Unknown
  The pattern is an amino acid coding region mosaic composed of pyknons.
  misc_feature: n indicates a number of nucleotides that separate the surrounding pyknons, as specified by Figure 13.
  misc_feature (1)..(1): n is a, c, g, or t
  misc_feature (18)..(18): n is a, c, g, or t
  misc_feature (35)..(35): n is a, c, g, or t
  misc_feature (52)..(52): n is a, c, g, or t
  misc_feature (69)..(69): n is a, c, g, or t
  misc_feature (86)..(86): n is a, c, g, or t
  misc_feature (103)..(103): n is a, c, g, or t
  misc_feature (120)..(120): n is a, c, g, or t
  misc_feature (137)..(137): n is a, c, g, or t
  misc_feature (154)..(154): n is a, c, g, or t
  misc_feature (171)..(171): n is a, c, g, or t
ncagccagagcagggcanaaagaaacatttcaaantcatactggagagaaantcatactggagagaaanaaatgtgaagaatgtgntcatactggagagaaantcatactggagagaaanaaatgtgaagaatgtgntcatactggagagaaanaaatgtgaagaatgtgn

SEQ ID NO: 747375 - DNA, 205 bp, Unknown
  The pattern is an amino acid coding region mosaic composed of pyknons.
  misc_feature: n indicates a number of nucleotides that separate the surrounding pyknons, as specified by Figure 13.
  misc_feature (1)..(1): n is a, c, g, or t
  misc_feature (18)..(18): n is a, c, g, or t
  misc_feature (35)..(35): n is a, c, g, or t
  misc_feature (52)..(52): n is a, c, g, or t
  misc_feature (69)..(69): n is a, c, g, or t
  misc_feature (86)..(86): n is a, c, g, or t
  misc_feature (103)..(103): n is a, c, g, or t
  misc_feature (120)..(120): n is a, c, g, or t
  misc_feature (137)..(137): n is a, c, g, or t
  misc_feature (154)..(154): n is a, c, g, or t
  misc_feature (171)..(171): n is a, c, g, or t
  misc_feature (188)..(188): n is a, c, g, or t
  misc_feature (205)..(205): n is a, c, g, or t
naaatgtgaagaatgtgnaaatgtgaagaatgtgnaaatgtgaagaatgtgntcatactggagagaaantcatactggagagaaantcatactggagagaaanaattcatatggaattgnaaatgtgaagaatgtgnactaatcataagagaanacactggagagaaaccnaaatgtgaagaatgtgnaaatgtgaagaatgtgn

SEQ ID NO: 747376 - DNA, 256 bp, Unknown
  The pattern is an amino acid coding region mosaic composed of pyknons.
  misc_feature: n indicates a number of nucleotides that separate the surrounding pyknons, as specified by Figure 13.
  misc_feature (1)..(1): n is a, c, g, or t
  misc_feature (18)..(18): n is a, c, g, or t
  misc_feature (35)..(35): n is a, c, g, or t
  misc_feature (52)..(52): n is a, c, g, or t
  misc_feature (69)..(69): n is a, c, g, or t
  misc_feature (86)..(86): n is a, c, g, or t
  misc_feature (103)..(103): n is a, c, g, or t
  misc_feature (120)..(120): n is a, c, g, or t
  misc_feature (137)..(137): n is a, c, g, or t
  misc_feature (154)..(154): n is a, c, g, or t
  misc_feature (171)..(171): n is a, c, g, or t
  misc_feature (188)..(188): n is a, c, g, or t
  misc_feature (205)..(205): n is a, c, g, or t
  misc_feature (222)..(222): n is a, c, g, or t
  misc_feature (239)..(239): n is a, c, g, or t
  misc_feature (256)..(256): n is a, c, g, or t
naaaaatgtggaaatgantttaataaattttcacnaaatgtaaagaatgtgnaaagaaattataccaanaaatgtgaagaatgtgnaaatgtgaagaatgtgnaaatgtgaagaatgtgnaaatgtaaagaatgtgnacactcctcagcccttnacactggagagaaaccnaaatgtgaagaatgtgnaaatgtgaagaatgtgnacaagtgtgaagaatgnaaatgtgaagaatgtgntcatactggagagaaan

SEQ ID NO: 747377 - DNA, 205 bp, Unknown
  The pattern is an amino acid coding region mosaic composed of pyknons.
  misc_feature: n indicates a number of nucleotides that separate the surrounding pyknons, as specified by Figure 13.
  misc_feature (1)..(1): n is a, c, g, or t
  misc_feature (18)..(18): n is a, c, g, or t
  misc_feature (35)..(35): n is a, c, g, or t
  misc_feature (52)..(52): n is a, c, g, or t
  misc_feature (69)..(69): n is a, c, g, or t
  misc_feature (86)..(86): n is a, c, g, or t
  misc_feature (103)..(103): n is a, c, g, or t
  misc_feature (120)..(120): n is a, c, g, or t
  misc_feature (137)..(137): n is a, c, g, or t
  misc_feature (154)..(154): n is a, c, g, or t
  misc_feature (171)..(171): n is a, c, g, or t
  misc_feature (188)..(188): n is a, c, g, or t
  misc_feature (205)..(205): n is a, c, g, or t
ncagccagagcagggcanaaagaaacatttcaaantcatactggagagaaantcatactggagagaaanaaatgtgaagaatgtgntcatactggagagaaantcatactggagagaaanaaatgtgaagaatgtgntcatactggagagaaanaaatgtgaagaatgtgntcatactggagagaaanaaatgtgaagaatgtgn

SEQ ID NO: 747378 - DNA, 205 bp, Unknown
  The pattern is an amino acid coding region mosaic composed of pyknons.
  misc_feature: n indicates a number of nucleotides that separate the surrounding pyknons, as specified by Figure 13.
  misc_feature (1)..(1): n is a, c, g, or t
  misc_feature (18)..(18): n is a, c, g, or t
  misc_feature (35)..(35): n is a, c, g, or t
  misc_feature (52)..(52): n is a, c, g, or t
  misc_feature (69)..(69): n is a, c, g, or t
  misc_feature (86)..(86): n is a, c, g, or t
  misc_feature (103)..(103): n is a, c, g, or t
  misc_feature (120)..(120): n is a, c, g, or t
  misc_feature (137)..(137): n is a, c, g, or t
  misc_feature (154)..(154): n is a, c, g, or t
  misc_feature (171)..(171): n is a, c, g, or t
  misc_feature (188)..(188): n is a, c, g, or t
  misc_feature (205)..(205): n is a, c, g, or t
ntttacaaataagaaaanaaatgtaaagaatgtgncatactgaagagaaacnacaagtgtgaagaatgnaaatgtgaagaatgtgnaaatgtgaagaatgtgnaaatgtgaagaatgtgncatactgaagagaaacnaaatgtgaagaatgtgncatactgaagagaaacntgaagaatgtatcagantcatactggagagaaan
